United States Patent
Barrett et al.

(10) Patent No.: US 11,896,614 B2
(45) Date of Patent: Feb. 13, 2024

(54) METHODS FOR IMPROVING THE EFFICACY AND EXPANSION OF CHIMERIC ANTIGEN RECEPTOR-EXPRESSING CELLS

(71) Applicants: Novartis AG, Basel (CH); The Trustees of the University of Pennsylvania, Philadelphia, PA (US)

(72) Inventors: David M. Barrett, Philadelphia, PA (US); Felipe Bedoya, Melrose, MA (US); Saba Ghassemi, Philadelphia, PA (US); Carl H. June, Merion Station, PA (US); Bruce L. Levine, Cherry Hill, NJ (US); Jan J. Melenhorst, Moreland Hills, OH (US); Michael C. Milone, Moorestown, NJ (US); Daniel J. Powell, Jr., Bala Cynwyd, PA (US); Nathan Amar Singh, Philadelphia, PA (US); Zoe Zheng, Cherry Hill, NJ (US)

(73) Assignees: Novartis AG, Basel (CH); The Trustees of the University of Pennsylvania, Philadelphia, PA (US)

( * ) Notice: Subject to any disclaimer, the term of this patent is extended or adjusted under 35 U.S.C. 154(b) by 528 days.

(21) Appl. No.: 15/567,156

(22) PCT Filed: Apr. 15, 2016

(86) PCT No.: PCT/US2016/027751
§ 371 (c)(1),
(2) Date: Oct. 17, 2017

(87) PCT Pub. No.: WO2016/168595
PCT Pub. Date: Oct. 20, 2016

(65) Prior Publication Data
US 2018/0133296 A1    May 17, 2018

Related U.S. Application Data

(60) Provisional application No. 62/149,249, filed on Apr. 17, 2015.

(51) Int. Cl.
| | | |
|---|---|---|
| *A61K 35/17* | (2015.01) | |
| *C07K 14/47* | (2006.01) | |
| *C07K 14/705* | (2006.01) | |
| *A61K 38/50* | (2006.01) | |
| *A61K 45/06* | (2006.01) | |
| *C07K 16/28* | (2006.01) | |
| *C12N 5/0783* | (2010.01) | |
| *C07K 14/725* | (2006.01) | |
| *A61K 39/00* | (2006.01) | |

(52) U.S. Cl.
CPC .............. *A61K 35/17* (2013.01); *A61K 38/50* (2013.01); *A61K 45/06* (2013.01); *C07K 14/4748* (2013.01); *C07K 14/705* (2013.01); *C07K 14/7051* (2013.01); *C07K 14/70517* (2013.01); *C07K 14/70578* (2013.01); *C07K 16/28* (2013.01); *C07K 16/2803* (2013.01); *C12N 5/0636* (2013.01); *C12Y 305/01001* (2013.01); *A61K 2039/5156* (2013.01); *A61K 2039/5158* (2013.01); *C07K 2317/622* (2013.01); *C07K 2319/00* (2013.01); *C07K 2319/03* (2013.01); *C07K 2319/33* (2013.01); *C12N 2501/2302* (2013.01); *C12N 2501/2305* (2013.01); *C12N 2501/2307* (2013.01); *C12N 2501/2318* (2013.01)

(58) Field of Classification Search
CPC ........ A61K 35/17; A61K 38/50; A61K 45/06; A61K 39/0011; A61K 2039/5156; A61K 2039/5158; C07K 14/4748; C07K 14/705; C07K 16/2803; C07K 14/7051; C07K 14/70517; C07K 14/70578; C07K 16/28; C07K 2319/03; C07K 2319/33; C07K 2317/622; C07K 2319/00; C12Y 305/01001; C12N 5/0636; C12N 2501/2302; C12N 2501/2305; C12N 2501/2307; C12N 2501/2318; A61P 43/00; A61P 37/04; A61P 35/02; A61P 35/00
See application file for complete search history.

(56) References Cited

U.S. PATENT DOCUMENTS

| | | | |
|---|---|---|---|
| 5,359,046 | A | 10/1994 | Capon et al. |
| 5,686,281 | A | 11/1997 | Roberts |
| 5,712,149 | A | 1/1998 | Roberts |
| 5,874,240 | A | 2/1999 | Ni et al. |
| 5,906,936 | A | 5/1999 | Eshhar et al. |

(Continued)

FOREIGN PATENT DOCUMENTS

| | | | |
|---|---|---|---|
| CN | 104507537 | A | 4/2015 |
| CN | 105158466 | A | 12/2015 |

(Continued)

OTHER PUBLICATIONS

Hinrichs et al. "Adoptively transferred effector cells derived from naive rather than central memory CD8+ T cells mediate superior antitumor immunity."Proc Natl Acad Sci U S A. Oct. 13, 2009;106(41): 17469-74. (Year: 2009).*

(Continued)

*Primary Examiner* — Titilayo Moloye
(74) *Attorney, Agent, or Firm* — K&L Gates LLP

(57) ABSTRACT

The invention provides methods of making immune effector cells (e.g., T cells, NK cells) that can be engineered to express a chimeric antigen receptor (CAR), compositions and reaction mixtures comprising the same, and methods of treatment using the same.

15 Claims, 41 Drawing Sheets
Specification includes a Sequence Listing.

(56) References Cited

U.S. PATENT DOCUMENTS

| | | |
|---|---|---|
| 6,103,521 A | 8/2000 | Capon et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |
| 6,475,481 B2 | 11/2002 | Talmadge |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,265,209 B2 | 9/2007 | Jensen |
| 7,319,143 B2 | 1/2008 | Gross et al. |
| 7,320,787 B2 | 1/2008 | Seed et al. |
| 7,446,190 B2 | 11/2008 | Sadelain et al. |
| 7,446,191 B2 | 11/2008 | Jensen |
| 7,514,537 B2 | 4/2009 | Jensen |
| 7,638,326 B2 | 12/2009 | June et al. |
| 7,741,465 B1 | 6/2010 | Eshhar et al. |
| 7,745,140 B2 | 6/2010 | June et al. |
| 7,754,482 B2 | 7/2010 | Riley et al. |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,272,002 B2 | 3/2016 | Powell, Jr. et al. |
| 9,328,156 B2 | 5/2016 | June et al. |
| 9,365,641 B2 | 6/2016 | June et al. |
| 9,394,368 B2 | 7/2016 | Brogdon et al. |
| 9,402,865 B2 | 8/2016 | Powell et al. |
| 9,422,351 B2 | 8/2016 | Scholler et al. |
| 9,446,105 B2 | 9/2016 | Powell, Jr. |
| 9,464,140 B2 | 10/2016 | June et al. |
| 9,481,728 B2 | 11/2016 | June et al. |
| 9,499,629 B2 | 11/2016 | June et al. |
| 9,518,123 B2 | 12/2016 | June et al. |
| 9,540,445 B2 | 1/2017 | June et al. |
| 9,572,836 B2 | 2/2017 | June et al. |
| 9,573,988 B2 | 2/2017 | Brogdon et al. |
| 9,598,489 B2 | 3/2017 | Powell, Jr. |
| 9,708,384 B2 | 7/2017 | Scholler et al. |
| 9,714,278 B2 | 7/2017 | June et al. |
| 9,745,368 B2 | 8/2017 | Milone et al. |
| 9,765,156 B2 | 9/2017 | June et al. |
| 9,777,061 B2 | 10/2017 | Ebersbach et al. |
| 9,815,901 B2 | 11/2017 | Brogdon et al. |
| 10,273,300 B2 | 4/2019 | Bedoya et al. |
| 10,829,735 B2 | 11/2020 | Bedoya et al. |
| 2003/0060444 A1 | 3/2003 | Finney et al. |
| 2003/0077249 A1 | 4/2003 | Bebbington et al. |
| 2003/0105000 A1 | 6/2003 | Pero et al. |
| 2003/0147869 A1 | 8/2003 | Riley et al. |
| 2003/0148982 A1 | 8/2003 | Brenner et al. |
| 2003/0224520 A1 | 12/2003 | June et al. |
| 2004/0038886 A1 | 2/2004 | Finney et al. |
| 2004/0043401 A1 | 3/2004 | Sadelain et al. |
| 2004/0101519 A1 | 5/2004 | June et al. |
| 2004/0110290 A1 | 6/2004 | June et al. |
| 2005/0113564 A1 | 5/2005 | Campana et al. |
| 2005/0129671 A1 | 6/2005 | Cooper et al. |
| 2006/0034810 A1 | 2/2006 | Riley et al. |
| 2007/0036773 A1 | 2/2007 | Cooper et al. |
| 2008/0131415 A1 | 6/2008 | Riddell et al. |
| 2008/0160091 A1 | 7/2008 | Oraevsky et al. |
| 2009/0257994 A1 | 10/2009 | Jensen |
| 2010/0261269 A1 | 10/2010 | June et al. |
| 2011/0052554 A1 | 3/2011 | Zakrzewski et al. |
| 2011/0262467 A1 | 10/2011 | Riley et al. |
| 2012/0027802 A1 | 2/2012 | Bonini et al. |
| 2012/0148552 A1 | 6/2012 | Jensen |
| 2012/0302466 A1 | 11/2012 | Sentman |
| 2012/0321667 A1 | 12/2012 | Sentman |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0287748 A1 | 10/2013 | June et al. |
| 2013/0288368 A1 | 10/2013 | June et al. |
| 2013/0309258 A1 | 11/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212398 A1* | 7/2014 | Reisner ................ A61K 35/28 424/93.71 |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1* | 9/2014 | Brogdon .......... C07K 14/70503 424/133.1 |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0370017 A1 | 12/2014 | June et al. |
| 2014/0370045 A1 | 12/2014 | June et al. |
| 2015/0017141 A1 | 1/2015 | June et al. |
| 2015/0024482 A1 | 1/2015 | Frigault et al. |
| 2015/0050729 A1 | 2/2015 | June et al. |
| 2015/0093822 A1 | 4/2015 | June et al. |
| 2015/0099299 A1 | 4/2015 | June et al. |
| 2015/0118202 A1 | 4/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0037369 A1* | 2/2017 | Ramsborg ............... A61P 35/00 |
| 2017/0081411 A1 | 3/2017 | Engels et al. |
| 2017/0136063 A1 | 5/2017 | Perez et al. |
| 2017/0137783 A1 | 5/2017 | Bedoya et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0260268 A1 | 9/2017 | Beatty et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |
| 2018/0044424 A1 | 2/2018 | June et al. |
| 2018/0118834 A1 | 5/2018 | Brogdon et al. |
| 2018/0125892 A1 | 5/2018 | Brannetti et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0252727 A1 | 9/2018 | Garfall et al. |
| 2018/0258149 A1 | 9/2018 | Motz et al. |
| 2018/0298068 A1 | 10/2018 | Albelda |
| 2018/0312595 A1 | 11/2018 | Brogdon et al. |
| 2019/0000880 A1 | 1/2019 | Motz et al. |

(56) References Cited

U.S. PATENT DOCUMENTS

| | | |
|---|---|---|
| 2019/0000944 A1 | 1/2019 | Brogdon et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |
| 2019/0263914 A1 | 8/2019 | Brogdon et al. |
| 2019/0269727 A1 | 9/2019 | Fachin et al. |
| 2019/0292238 A1 | 9/2019 | Bitter et al. |
| 2019/0292257 A1 | 9/2019 | Bedoya et al. |
| 2019/0298715 A1 | 10/2019 | Motz et al. |
| 2019/0330356 A1 | 10/2019 | Brogdon et al. |
| 2019/0336504 A1 | 11/2019 | Gill et al. |
| 2019/0375815 A1 | 12/2019 | Engels et al. |
| 2019/0382500 A1 | 12/2019 | Abujoub et al. |
| 2019/0388471 A1 | 12/2019 | June et al. |
| 2019/0389928 A1 | 12/2019 | Posey et al. |
| 2020/0048359 A1 | 2/2020 | Albelda et al. |
| 2020/0055948 A1 | 2/2020 | Daley et al. |
| 2020/0061113 A1 | 2/2020 | Kassim et al. |
| 2020/0085869 A1 | 3/2020 | Schuster et al. |
| 2020/0087376 A1 | 3/2020 | Fraietta et al. |
| 2020/0113941 A1 | 4/2020 | Brannetti et al. |
| 2020/0179511 A1 | 6/2020 | Daley et al. |
| 2020/0215171 A1 | 7/2020 | Brogdon et al. |
| 2020/0281973 A1 | 9/2020 | Dranoff |
| 2020/0283729 A1 | 9/2020 | Loew et al. |
| 2020/0291354 A1 | 9/2020 | Johnson et al. |
| 2020/0339704 A1 | 10/2020 | Bradner et al. |
| 2020/0360431 A1 | 11/2020 | Garfall et al. |
| 2020/0368268 A1 | 11/2020 | Johnson et al. |
| 2020/0370012 A1 | 11/2020 | Fraietta et al. |
| 2020/0371091 A1 | 11/2020 | Pruteanu-Malinici et al. |
| 2020/0399383 A1 | 12/2020 | Scholler et al. |
| 2021/0002377 A1 | 1/2021 | Brogdon et al. |
| 2021/0047405 A1 | 2/2021 | Nobles et al. |
| 2021/0079073 A1 | 3/2021 | Milone et al. |
| 2021/0087279 A1 | 3/2021 | Engels et al. |
| 2021/0123016 A1 | 4/2021 | Ihry et al. |
| 2021/0139595 A1 | 5/2021 | Ebersbach et al. |
| 2021/0171909 A1 | 6/2021 | Golovina et al. |
| 2021/0172020 A1 | 6/2021 | Bedoya et al. |
| 2021/0177896 A1 | 6/2021 | Porter et al. |
| 2021/0177900 A1 | 6/2021 | Engels et al. |
| 2021/0213063 A1 | 7/2021 | Isaacs et al. |
| 2021/0214459 A1 | 7/2021 | Brock et al. |
| 2021/0220404 A1 | 7/2021 | Abujoub et al. |
| 2021/0284752 A1 | 9/2021 | Brogdon et al. |
| 2021/0317183 A1 | 10/2021 | Zhao et al. |
| 2021/0347851 A1 | 11/2021 | Isaacs et al. |
| 2021/0246423 A1 | 12/2021 | Bedoya et al. |
| 2021/0396739 A1 | 12/2021 | Pruteanu-Malinici et al. |
| 2022/0047633 A1 | 2/2022 | Grupp |
| 2022/0064316 A1 | 3/2022 | Brogdon et al. |
| 2022/0089750 A1 | 3/2022 | June et al. |
| 2022/0152150 A1 | 5/2022 | Koshy et al. |
| 2022/0168389 A1 | 6/2022 | Ghassemi et al. |
| 2022/0195010 A1 | 6/2022 | Bitter et al. |
| 2022/0251152 A1 | 8/2022 | Carbonneau et al. |
| 2022/0364055 A1 | 11/2022 | Treanor et al. |
| 2022/0387486 A1 | 12/2022 | Brannetti et al. |
| 2023/0026049 A1 | 1/2023 | Brogdon et al. |
| 2023/0071283 A1 | 3/2023 | Golosov et al. |
| 2023/0074800 A1 | 3/2023 | Berger et al. |
| 2023/0111593 A1 | 4/2023 | Schuster et al. |
| 2023/0139800 A1 | 5/2023 | Motz et al. |

FOREIGN PATENT DOCUMENTS

| | | | |
|---|---|---|---|
| EP | 0574512 A1 | 12/1993 | |
| EP | 0871495 A1 | 10/1998 | |
| EP | 1226244 A2 | 7/2002 | |
| EP | 1955708 A1 | 8/2008 | |
| WO | 1992015322 A1 | 9/1992 | |
| WO | 199530014 A1 | 11/1995 | |
| WO | 9623814 A1 | 8/1996 | |
| WO | 9624671 A1 | 8/1996 | |
| WO | 1997015669 A1 | 5/1997 | |
| WO | 9723613 A2 | 7/1997 | |
| WO | 9818809 A1 | 5/1998 | |
| WO | 9853048 A1 | 11/1998 | |
| WO | 9900494 A2 | 1/1999 | |
| WO | 9957268 A1 | 11/1999 | |
| WO | 0014257 A1 | 3/2000 | |
| WO | 2002033101 A1 | 4/2002 | |
| WO | 02077029 A2 | 10/2002 | |
| WO | 02088334 A1 | 11/2002 | |
| WO | 2003057171 A2 | 7/2003 | |
| WO | 2005019429 A2 | 3/2005 | |
| WO | 2005044996 A2 | 5/2005 | |
| WO | 2005/118788 A2 | 12/2005 | |
| WO | 2006060878 A1 | 6/2006 | |
| WO | 2008045437 A2 | 4/2008 | |
| WO | 2010085660 A2 | 7/2010 | |
| WO | 2011059836 A2 | 5/2011 | |
| WO | 2011097477 A1 | 8/2011 | |
| WO | 2012058460 A2 | 5/2012 | |
| WO | 2012079000 A1 | 6/2012 | |
| WO | 2012082841 A2 | 6/2012 | |
| WO | 2012/099973 A2 | 7/2012 | |
| WO | 2012127464 A2 | 9/2012 | |
| WO | 2012129514 A1 | 9/2012 | |
| WO | 2012135854 A2 | 10/2012 | |
| WO | 2012138858 A1 | 10/2012 | |
| WO | 2013019615 A2 | 2/2013 | |
| WO | 2013033626 A2 | 3/2013 | |
| WO | 2013040371 A2 | 3/2013 | |
| WO | 2013040557 A2 | 3/2013 | |
| WO | 2013059593 A1 | 4/2013 | |
| WO | 2013074916 A1 | 5/2013 | |
| WO | 2013/126712 A1 | 8/2013 | |
| WO | 2013126729 A1 | 8/2013 | |
| WO | 2013126733 A1 | 8/2013 | |
| WO | 2013142034 A1 | 9/2013 | |
| WO | 2014/011984 A1 | 1/2014 | |
| WO | 2014/011987 A1 | 1/2014 | |
| WO | 2014/011993 A2 | 1/2014 | |
| WO | 2014/012001 A2 | 1/2014 | |
| WO | 2014011988 A2 | 1/2014 | |
| WO | 2014011996 A1 | 1/2014 | |
| WO | 2014031687 A1 | 2/2014 | |
| WO | 2014039513 A2 | 3/2014 | |
| WO | WO-2014039044 A1 * | 3/2014 | ............ A61K 35/17 |
| WO | 2014/055442 A2 | 4/2014 | |
| WO | 2014/055771 A1 | 4/2014 | |
| WO | 2014055657 A1 | 4/2014 | |
| WO | 2014055668 A1 | 4/2014 | |
| WO | 2014/127261 A1 | 8/2014 | |
| WO | 2014124134 A1 | 8/2014 | |
| WO | 2014130635 A1 | 8/2014 | |
| WO | 2014/145252 A2 | 9/2014 | |
| WO | 2014138704 A1 | 9/2014 | |
| WO | 2014153270 A1 | 9/2014 | |
| WO | 2014186469 A2 | 11/2014 | |
| WO | 2014190273 A1 | 11/2014 | |
| WO | 2015090229 A1 | 6/2015 | |
| WO | 2015090230 A1 | 6/2015 | |
| WO | 2015112626 A1 | 7/2015 | |
| WO | 2015/142661 A1 | 9/2015 | |
| WO | 2015142675 A2 | 9/2015 | |
| WO | 2015157252 A1 | 10/2015 | |
| WO | 2015162211 A1 | 10/2015 | |
| WO | 2015164675 A1 | 10/2015 | |
| WO | 2015164745 A1 | 10/2015 | |
| WO | 2016014501 A1 | 1/2016 | |
| WO | 2016014530 A1 | 1/2016 | |
| WO | 2016014535 A1 | 1/2016 | |
| WO | 2016014553 A1 | 1/2016 | |
| WO | 2016014565 A2 | 1/2016 | |
| WO | 2016014576 A1 | 1/2016 | |
| WO | 2016019300 A1 | 2/2016 | |
| WO | 2016025880 A1 | 2/2016 | |
| WO | 2016028896 A1 | 2/2016 | |
| WO | 2016044605 A1 | 3/2016 | |
| WO | 2016/057705 A1 | 4/2016 | |

(56) References Cited

FOREIGN PATENT DOCUMENTS

| WO | 2016/109410 | A2 | 7/2016 |
|---|---|---|---|
| WO | 2016/168595 | A1 | 10/2016 |
| WO | 2016164731 | A2 | 10/2016 |
| WO | 2017015427 | A1 | 1/2017 |
| WO | 2017049166 | A1 | 3/2017 |
| WO | 2017117112 | A1 | 7/2017 |

OTHER PUBLICATIONS

Kandalaft et al. "A phase I clinical trial of adoptive transfer of folate receptor-alpha redirected autologous T cells for recurrent ovarian cancer."Journal of Translational Medicine vol. 10, Article No. 157 (2012) (Year: 2012).*

Klebanoff et al. "Central memory self/tumor-reactive CD8+ T cells confer superior antitumor immunity compared with effector memory T cells"Proc Natl Acad Sci U S A .Jul. 5, 2005;102(27):9571-6. (Year: 2005).*

Litterman et al. "Profound Impairment of Adaptive Immune Responses by Alkylating Chemotherapy."J Immunol Jun. 15, 2013, 190 (12) 6259-6268 (Year: 2013).*

No author Listed. "How Chemotherapy Drugs Work." retrieved from https://www.cancer.org/treatment/treatments-and-side-effects/treatment-types/chemotherapy/how-chemotherapy-drugs-work.html. acessed Nov. 28, 2022 (Year: 2022).*

Pule et al., "Virus-specific T cells engineered to coexpress tumor-specific receptors: persistence and antitumor activity in individuals with neuroblastoma" Nat. Med. (2008) vol. 14 No. 11 pp. 1264-1270.

Rapoport et al., "Restoration of immunity in lymphopenic individuals with cancer by vaccination and adoptive T-cell transfer" Nature Medicine (2005) vol. 11 No. 11 pp. 1230-1237.

Roederer, "T-cell dynamics of immunodeficiency" Nature Medicine (1995) vol. 1 No. 7 pp. 621-622.

Romeo et al., "Cellular immunity to HIV activated by CD4 fused to T cell or Fc receptor polypeptides," Cell 64:1037-1046 (1991).

Rufer et al. "Transfer of the human telomerase reverse transcriptase (TERT) gene into T lymphocytes results in extension of replicative potential", Blood (2001) pp. 597-603.

Sabbagh et al., "TNF family ligands define niches for T cell memory" Trends in Immunology (2007) vol. 28 No. 8 pp. 333-339.

Sadelain et al. "The promise and potential pitfalls of chimeric antigen receptors." Current Opinion Immunology (2009) vol. 21 No. 2 pp. 215-223.

Sadelain et al., "Targeting Tumours with Genetically Enhanced T Lymphocytes," Nature Reviews: Cancer 3: 35-45 (2003).

Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.

Scourzic et al. "TET proteins and the control of cytosine demethylation in cancer" Genome Medicine (2015) vol. 7, No. 9, pp. 10-16.

Sebestyen et al., "Human TCR That Incorporate CD3 Induce Highly Preferred Pairing between TCR and Chains following Gene Transfer" Journal of Immunology (2008) vol. 180 pp. 7736-7746.

Shirasu et al., "Functional Design of Chimeric T-Cell Antigen Receptors for Adoptive Immunotherapy of Cancer: Architecture and Outcomes," AntiCancer Res. 32: 2377-2384 (2012).

Singapore Search Report and Written Opinion for Singapore Application No. 11201705293W dated Mar. 22, 2018.

Singh et al. "Early memory phenotypes drive T cell proliferation in patients with pediatric malignancies", Science Translational Medicine (2012) vol. 8, No. 320, pp. 320ra3-320ra3.

Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.

Stroncek et al. "Highlights of the society for immunotherapy of cancer (SITC) 27th annual meeting" Journal for Immuno Therapy of Cancer (2013) vol. 1, No. 4, pp. 1-11.

Terakura et al. "Generation of CD19-chimeric antigen receptor modified CD8+ T cells derived from virus-specific central memory T cells" Blood (2012) vol. 119, No. 1, pp. 72-82.

Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.

Uckun et al., "Detailed studies on expression and function of CD19 surface determinant by using B43 monoclonal antibody and the clinical potential of anti-CD19 immunotoxins" Blood (1988) vol. 71 pp. 13-29.

Verbinnen et al. "Contribution of Regulatory T Cells and Effector T Cell Deletion in Tolerance Induction by Costimulation Blockade1" Journal of Immunology (2008) vol. 181, pp. 1034-1042.

Vinay & Kwon, "Role of 4-1BB in immune responses" Immunology (1998) vol. 10 pp. 481-489.

Wang et al. "CS-1 Re-Directed Central Memory T Cell Therapy for Multiple Myeloma" Blood (2014) vol. 124, No. 21, Meeting Abstract 1114.

Willemsen et al., "Genetic Engineering of T Cell Specificity for Immunotherapy of Cancer" Human Immunology (2003) vol. 64 pp. 56-68.

Wu et al. "Suppression of TET1-Dependent DNA Demethylation Is Essential for KRAS-Mediated Transformation" Cell Reports (2014) vol. 9, pp. 1827-1840.

Xu et al. "Oncometabolite 2-Hydroxyglutarate Is a Comparative Inhibitor of alpha-Ketoglutarate-Dependent Dioxygenases" Cancer Cell (2011) vol. 19, No. 1, pp. 17-30.

Zhang et al. "Down-regulation of TET2 in CD3+ and CD34+ cells of myelodysplastic syndromes and enhances CD34 + cells proliferation" Int J Clin Exp Pathol (2015) vol. 8, No. 9, pp. 10840-10846.

Zhang et al. "Efficiency of CD19 chimeric antigen receptor-modified T cells for treatment of B cell malignancies in phase I clinical trials: a meta analysis" Oncotarget (2015) vol. 6, No. 32, pp. 33961-33971.

Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.

Zufferey et al., "Multiply attenuated lentiviral vector achieves efficient gene delivery in vivo" Nature Biotechnology (1997) vol. 15 pp. 871-876.

Abaza et al. "Effects of Amino Acid Substituions Outside an Antigenic Site on Protein Binding to Monoclonal Antibodies of Predetermined Specificity Obtained by Peptide Immunization: Demonstration with Region 94-100 (Antigenic Site 3) of Myoglobin" Journal of Protein Chemistry (1992) vol. 11, No. 5, pp. 433-444.

Almagro et al. "Humanization of Antibodies" Frontiers in Bioscience (2008) vol. 13, pp. 1619-1633.

Colman et al. "Effects of amino acid sequence changes on antibody-antigen interactions" Research in Immunology (1994) vol. 145, No. 1, pp. 33-36.

Couper et al. "Anti-CD25 antibody-mediated depletion of effector T cell populations enhances susceptibility of mice to acute but not chronic Toxoplasma gondii infection" The Journal of Immunology (2009) vol. 182, No. 7, pp. 3985-3994.

Fujiwara et al. "Profiles Of De Novo CD25-Positive Mature B-Cell Lymphomas" Blood (2013) vol. 122, No. 21, pp. 4308 (1-6).

Giordano Attianese et al. "In vitro and in vivo model of a novel immunotherapy approach for chronic lymphocytic leukemia by anti-CD23 chimeric antigen receptor" Blood (2011) vol. 117, No. 18, pp. 4736-4745.

Hinrichs et al. "Adoptive transferred effector cells derived from naive rather than central memory CD8+ T cells mediate superior antitumor immunity" PNAS (2009) vol. 106, No. 41, pp. 17469-17474.

Jena et al. "Chimeric Antigen Receptor (CAR)-Specific Monoclonal Antibody to Detect CD19-Specific T Cells in Clinical Trials" PLOS ONE (2013) vol. 8, No. 3, e57838, pp. 1-12.

(56) References Cited

OTHER PUBLICATIONS

Kmieciak et al. "Ex vivo Expansion of Tumor-reactive T Cells by Means of Byrostatin 1/Ionomycin and the Common Gamma Chain Cytokines Formuation" Journal of Visualized Experiments (2011) vol. 47, doi: 10.3791/2381, pp. 1-4.
Lee et al. "T cells expressing CD19 chimeric antigen receptors for acute lymphoblastic leukaemia in children and young adults: a phase 1 doseescalation trial" Lancet (2014) vol. 385, No. 9967, pp. 517-528.
Piper et al. "Chronic lymphocytic leukemia cells drive the global CD4+ T cell repertoire towards a regulatory phenotype and leads to the accumulation of CD4+ forkhead box P3+ T cells" Clinical and Experimental Immunology (2011) vol. 166, No. 2, pp. 154-163.
Rudikoff et al. "Single amino acid substitution altering antigen-binding specificity" PNAS (1982) vol. 79, pp. 1979-1983.
Shvidel et al. "Cell surface expression of CD25 antigen (surface IL-2 receptor alpha-chain) is not a prognostic marker in chronic lymphocytic leukemia: results of a retrospective study of 281 patients" Ann Hematol (2012) vol. 91, pp. 1597-1602 pp. 1597-1602.
Singapore Search Report and Written Opinion for Singapore Application No. 11201708516Y dated Sep. 25, 2018.
Slaney et al."Dual-specific Chimeric Antigen Receptor T Cells and an Indirect Vaccine Eradicate a Variety of Large Solid Tumors in an Immunocompetent Self-antigen Setting" Clinical Cancer Research (2017) vol. 23, No. 10, pp. 2478-2490.
Taylor et al. "IL-10 suppresses CD2-mediated T cell activation via SHP-1" Molecular Immunology (2009) vol. 46, pp. 622-629.
Wilkie et al."Dual Targeting of ErbB2 and MUC1 in Breast Cancer Using Chimeric Antigen Receptors Engineered to Provide Complementary Signaling" J Clin Immunol (2012) vol. 32, pp. 1059-1070.
Baeksgaard & Sorensen, "Acute tumor lysis syndrome in solid tumors - a case report and review of the literature" Cancer Chemotherapy Pharmacology (2003) vol. 51 pp. 187-192.
Barrett et al. "Relation of clinical culture method to T-cell memory status and efficacy in xenograft models of adoptive immunotherapy", Cytotherapy (2014) vol. 16, No. 5, pp. 619-630.
Barsov et al. "Telomerase and primary T cells: biology and immortalization for adoptive immunotherapy" Immunotherapy (2011) vol. 3, No. 3, pp. 407-421.
Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19- Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy- Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor- Chain alone Are Insufficient to Prime Resting T Lymphocytes" J. Exp. Med. (1995) vol. 181 pp. 1653-1659.
Call & Wucherpfennig, "The T Cell Receptor: Critical Role of the Membrane Environment in Receptor Assembly and Function" Annu. Rev. Immunol. (2005) vol. 23 pp. 101-125.

Carpenito et al. "Control of large, established tumor xenografts with genetically retargeted human T cells containing CD28 and CD137 domains", Proc Natl Acad Sci USA (2009) vol. 106 pp. 3360-3365.
Cha et al. "IL-7 + IL-15 are superior to IL-2 for the ex vivo expansion of 4T1 mammary carcinoma-specific T cells with greater efficacy against tumors in vivo", Breast Cancer Research and Treatment, Kluwer Academic Publishers (2009) vol. 122, No. 2, pp. 359-369.
Cheadle et al. "CAR T cells: driving the road from the laboratory to the clinic", Immunological Reviews (2013), vol. 257, No. 1, pp. 91-106.
Davila et al. "B Cell Aplasia In a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dotti et al. " Design and development of therapies using chimeric antigen receptor-expressing T cells" Immunological Reviews (2013) vol. 257, No. 1, pp. 107-126.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al, "A Third-Generation Lentivirus Vector with a Conditional Packaging System" Journal of Virology (1998) vol. 72 No. 11 pp. 8463-8471.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Flynn et al. "Stem memory T cells (TSCM)-their role in cancer and HIV immunotherapies", Clinical & Translational Immunology (2014) vol. 3, No. 7, pp. 1-7.
Frey, N. "Genetically Engineered Lymphocyte Therapy in Treating Patients With B-Cell Leukemia or Lymphoma That s Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093 (2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/ NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.

(56) References Cited

OTHER PUBLICATIONS

Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Han et al. "Malignant B Cells Induce the Conversion of CD4+ CD25- T Cells to Regulatory T Cells in B-Cell Non-Hodgkin Lymphoma" PLOS One (2011) vol. 6, No. 12, e28649.
Hekele et al., "Growth Retardation of Tumors By Adoptive Transfer of Cytotoxic T Lymphocytes Reprogrammed By CD44V6-SPECIFIC SCFV:∼—CHIMERA" Int J. Cancer (1996) vol. 68 pp. 232-238.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Hosing et al. "CARs in Chronic Lymphocytic Leukemia—Ready to Drive", Current Hematologic Malignancy Reports (2012) vol. 8, No. 1, pp. 60-70.
Husebekk et al. "Selection and expansion of T cells from untreated patients with CLL: source of cells for immune reconstitution?" Cytotherapy (2000) vol. 2, No. 3, pp. 187-193.
Imai et al., "Chimeric receptors with 4-1BB signaling capacity provoke potent cytotoxicity against acute lymphoblastic leukemia," Leukemia 18: 676-684 (2004).
imai et al., "Genetic modification of primary natural killer cells overcomes inhibitory signals and induces specific killing of leukemic cells" Blood (2005) vol. 106 No. 1 pp. 376-383.
International Search Report and Written Opinion for International Application No. PCT/US2015/067635 dated Apr. 19, 2016.
International Search Report and Written Opinion for International Application No. PCT/US2016/043255 dated Dec. 16, 2016.
International Search Report and Written Opinion for International Application No. PCT/US2016/052260 dated Jan. 16, 2017.
International Search Report and Written Opinion for International Application No. PCT/US2016/068683 dated Mar. 29, 2017.
International Search Report and Written Opinion from International Application No. PCT/US2016/027751 dated Jan. 7, 2016.
International Search Report from PCT/US2011/064191 dated Jan. 5, 2012.
Irving et al., "The cytoplasmic domain of the T cell receptor zeta chain is sufficient to couple to receptor-associated signal transduction pathways," Cell 64: 891-901 (1991).
Jena, Bipulendu et al. "Redirecting T-cell specificity by introducing a tumor-specific chimeric antigen receptor, Blood, May 3, 2010", vol. 116, No. 7, pp. 1035-1044.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
Jones et al., "Circulating clonotypic B cells in classic Hodgkin lymphoma." Blood (2009) vol. 113 No. 23 pp. 5920-5926.
Joo et al., "Targeted cancer therapy—are the days of systemic chemotherapy numbered?" Maturitas (2013) vol. 76 No. 4 pp. 308-314.
June et al., "Engineering lymphocyte subsets: tools, trials and tribulations" Nat Rev Immunol (2009) vol. 9 No. 10 pp. 704-716.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al., "Human 4-1BB regulates CD28 co-stimulation to promote Th1 cell responses" Eur. J. Immunol. (1998) vol. 28 pp. 881-890.
Kochenderfer et al., "A Phase I Clinical Trial of Treatment of B-Cell Malignancies with Autologous Anti-Cd19-CAR-Transduced T Cells" BLOOD (2010) vol. 116 No. 21 pp. 1179-1180 & 52nd Annual Meeting of the American-Society-Of-Hematology (Ash); Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 389-702.
Kochenderfer et al., "Eradication of B-lineage cells and regression of lymphoma in a patient treated with autologous T cells genetically-engineered to recognize CD19," Blood 116: 4099-4102 (2010).
Koehler et al. "Engineered T Cells for the Adoptive Therapy of B-Cell Chronic Lymphocytic Leukaemia", Advances In Hematology (2012) vol. 180, No. 9, pp. 6365-13.
Kohn et al. "CARs on Track in the Clinic", Molecular Therapy (2011) vol. 19, No. 3, pp. 432-438.
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kwon et al., "cDNA sequences of two inducible T-cell genes". Proc. Natl. Acad. Sci. U.S.A. 86(6): 1963-1967 (1989).
Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.
Lee et al., "In vivo Inhibition of Human CD19-Targeted Effector T Cells by Natural T Regulatory Cells in a Kenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Lipowska-Bhalla et al. "Targeted immunotherapy of cancer with Car T cells: achievements and challenges", Cancer Immunology Immunotherapy 2012) vol. 61 pp. 953-962.
Macallan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).

(56) References Cited

OTHER PUBLICATIONS

McGuinness et al., "Anti-tumor activity of human T cells expressing the CC49-zeta chimeric immune receptor," Hum. Gene Ther. 10: 165-173 (1999).
Milone et al., "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Molina, "A Decade of Rituximab: Improving Survival Outcomes in Non-Hodgkin's Lymphoma" Annu. Rev. Med. (2008) vol. 59 pp. 237-250.
Moran-Crusio et al. "Tet2 Loss Leads to Increased Hematopoietic Stem Cell Self-Renewal and Myeloid Transformation" Cancer Cell (2011) vol. 20, pp. 11-24.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(16-17): 1157-1165 (1997).
PARK and BRENTJENS "Adoptive Immunotherapy for B-cell Malignancies with Autologous Chimeric Antigen Receptor Modified Tumor Targeted T Cells" Discovery Medicine (2010) vol. 9 No 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No 4 pp. 825-833.
Partial International Search Report for International Application No. PCT/US2016/068683 dated Apr. 18, 2017.
Partial Search Report and Invitation to Pay Additional Fees for International Application No. PCT/US2016/052260 dated Nov. 16, 2016.
Patel et al., "Impact of chimeric immune receptor extracellular protein domains on T cell function" Gene Therapy (1999) vol. 6 pp. 412-419.
Porter et al. "Chimeric Antigen Receptor-Modified T Cells in Chronic Lymphoid Leukemia", The New England Journal of Medicine (2011) vol. 365 No 8 pp. 725-733.
Porter et al., "A phase 1 trial of donor lumphocyte infusions expanded and activated ex vivo via CD3/CD28 costimulation" Blood (2006) vol. 107 No 4 pp. 1325-1331.
Porter et al., "Chimeric Antigen Receptor Therapy for B-cell Malignancies" Journal of Cancer (2011) vol. 2 pp. 331-332.
Powell et al. "Large-Scale Depletion of CD25+ Regulatory T Cells from Patient Leukapheresis Samples" Journal of Immunotherapy (2005) vol. 28, No. 4, pp. 403-411.
Powell et al. "Partial Reduction of Human FOXP3+ CD4 T Cells In Vivo After CD25-directed Recombinant Immunotoxin Administration" J Immunother (2008) vol. 31, pp. 189-198.
Priceman et al., "Smart CARs Engineered for Cancer Immunotherapy" Curr Opin Oncol (2015) vol. 27, No. 6, pp. 466-474.
Powell et al. "Efficient clincial-scale enrichment of lymphocytes for use in adoptive immunotherapy using a modified counterflow centrifugal elutriation program" Cytotherapy (2009) vol. 11, No. 7, pp. 923-935.
Lemarie et al. "Purification of monocytes from cryopreserved mobilized apheresis products by elutriation with the Elutra device" Journal of Immunological Methods (2007) vol. 318, pp. 30-36.
Stroncek et al. "Counter-flow elutriation of clinical peripheral blood mononuclear cell concentrates for the production of dendritic and T cell therapies" Journal of Translational Medicine (2014) vol. 12, No. 241, pp. 1-8.
Wang et al. "Phenotypic and Functional Attributes of Lentivirus Modified CD19-specific Human CD8+ Central Memory T Cells Manufactured at Clinical Scale" J Immunother (2012) vol. 35, No. 9, pp. 689-701.
Xu et al., "Closely related T-memory stem cells correlate with in vivo expansion of CAR.CD19-T cells and are preserved by IL-7 and IL-15," Blood (2014), vol. 123, No. 24, pp. 3750-3759.
Alves et al., "Common gamma chain cytokines: Dissidence in the details," Immunology Letters (2007) vol. 108, pp. 113-120.
Hoyos et al., "Engineering CD19-specific T lymphocytes with interleukin-15 and a suicide gene to enhance their anti-lymphoma/leukemia effects and safety," Leukemia (2010) vol. 24, pp. 1160-1170.
Hurton et al., "Tethered IL15 on CD19-Specific T Cells Sustains Long-Term Persistence and Promotes a Stem Cell Memory-Like Phenotype," Molecular Therapy (2014) vol. 22, p. S.242, Abstract 626.
Kaneko et al., "IL-7 and IL-15 allow the generation of suicide gene-modified alloreactive self-renewing central memory human T lymphocytes," Blood (2009) vol. 113, pp. 1006-1015.
Lamers et al., "T Cell Receptor-Engineered T Cells to Treat Solid Tumors: T Cell Processing Toward Optimal T Cell Fitness," Human Gene Therapy Methods (2014) vol. 25, pp. 345-357.
[No Author Listed] "Biofiles," Sigma-Aldrich Catalog (2014) vol. 6, No. 5, 32 pages.
[No Author Listed] News Release, "FDA Approves Personalized Cellular Therapy for Advanced Leukemia Developed by University of Pennsylvania and Children's Hospital of Philadelphia," Aug. 30, 2017, 4 pages.
Ochoa et al., "Immune Defects in T Cells From Cancer Patients," Chapter 2, pp. 35-48 in Current Clinical Oncology: Cancer Immunotherapy at the Crossroads: How Tumors Evade Immunity and What Can be Done Finke et al., Ed. (2004) Humana Press, Totowa, New Jersey.
Pouw et al., Combination of IL-21 and IL-15 enhances tumour-specific cytotoxicity and cytokine production of TCR-transduced primary T cells, Cancer Immunol Immunother (2010) vol. 59, pp. 921-931.
Solomayer et al., "Influence of Adjuvant Hormone Therapy and Chemotherapy on the Immune System Analysed in the Bone Marrow of Patients with Breast Cancer," Clin Cancer Res (2003) vol. 9, pp. 174-180.
Xu et al., "gamma-c Cytokines IL7 and IL15 Expanded Chimeric Antigen Receptor-Redirected T Cells (CAR-T) with Superior Anti-tumor Activity In Vivo," 16th Annual Meeting of the American Society of Gene and Cell Therapy (2013) vol. 21, Supp. 1, pp. S20-S21.
[No Author Listed] Elutriation—Wikipedia, pp. 1-2 ; downloaded on Oct. 23, 2021.
Bergamaschi et al., "Heterodimeric IL-15 promotes tumor control through the regulation of the balance of effector and regulatory cells via an IL-2 deprivation mechanism," Cytokine (2014) vol. 70, Iss. 1, pp. 29-30.
Hedge et al., "Combinational Targeting Offsets Antigen Escape and Enhances Effector Functions of Adoptively Transferred T Cells in Glioblastoma," Molecular Therapy (2013) vol. 21, No. 11 , pp. 2087-2101.

* cited by examiner

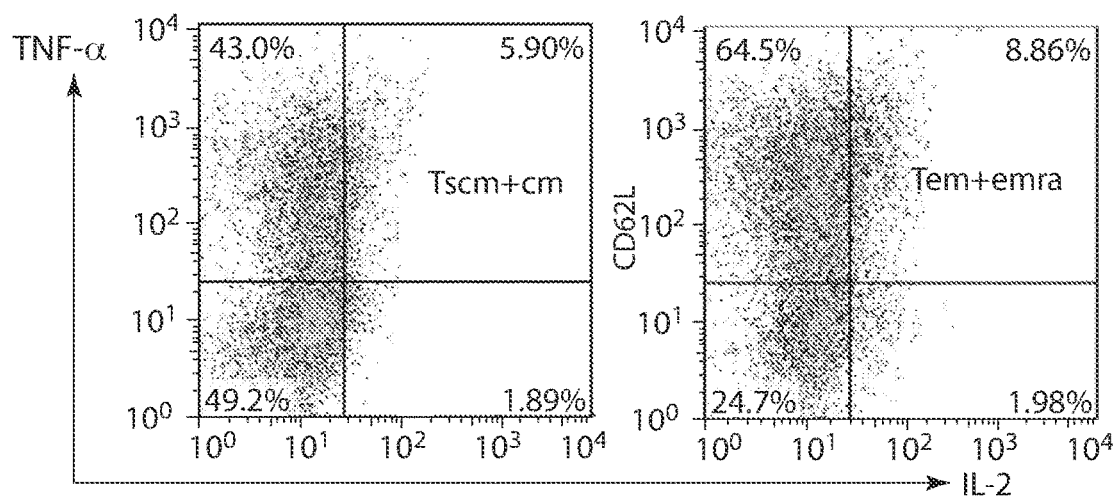
FIG. 6A
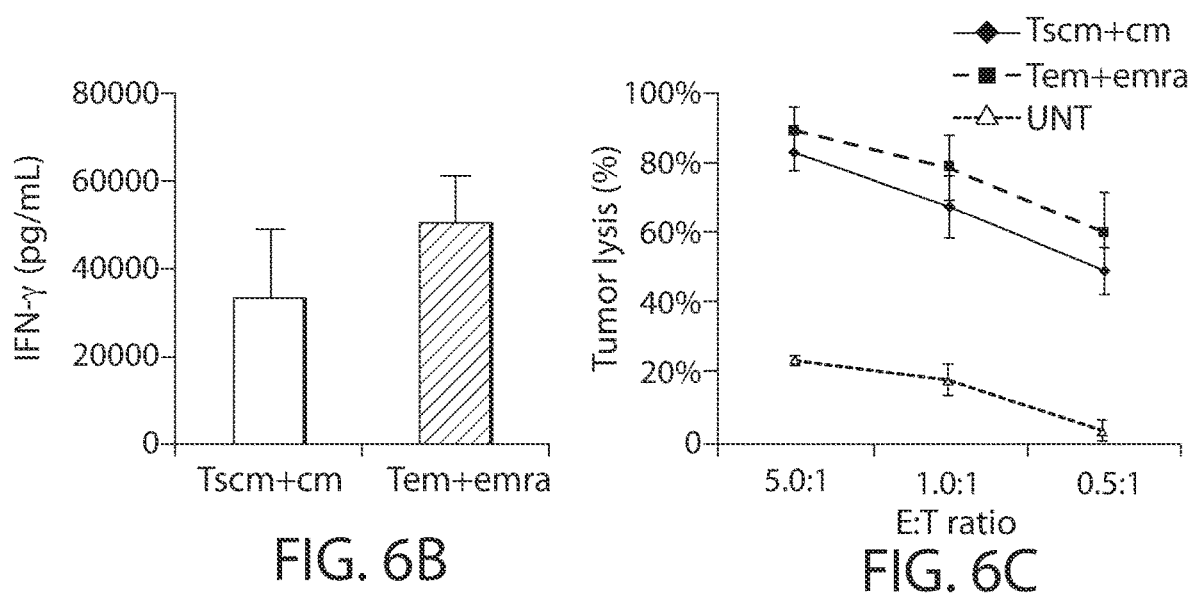
FIG. 6B
FIG. 6C

ALC

| | | | | | | |
|---|---|---|---|---|---|---|
| Leukemia n = | 38 | 37 | 34 | 30 | 26 | 21 |
| Lymphoma n = | 12 | 11 | 10 | 9 | 9 | 5 |

Terminal effector

Naive

METHODS FOR IMPROVING THE EFFICACY AND EXPANSION OF CHIMERIC ANTIGEN RECEPTOR-EXPRESSING CELLS

This application is a U.S. National Stage Application under 35 U.S.C. § 371 of International Application No. PCT/US2016/027751, filed Apr. 15, 2016, which claims priority to U.S. Ser. No. 62/149,249 filed Apr. 17, 2015, the contents of each of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Apr. 14, 2016, is named N2067-7094WO_SL.txt and is 720,042 bytes in size.

FIELD OF THE INVENTION

The present invention relates generally to immune effector cells (e.g., T cells, NK cells) engineered to express a Chimeric Antigen Receptor (CAR), compositions comprising the same, as well as methods of making and using the same.

BACKGROUND OF THE INVENTION

Adoptive cell transfer (ACT) therapy with autologous T-cells, especially with T-cells transduced with Chimeric Antigen Receptors (CARs), has shown promise in several hematologic cancer trials. Despite these promising results, many patients undergoing evaluation for enrollment are ultimately unable to proceed due to (at least in part) insufficient yields of clinically viable manufactured product. Such limitations in clinically viable manufactured products can arise as a result of several factors, including an inability to harvest adequate and sufficient lymphocytes from a patient, limitations of the harvested cells, and limited ex vivo cellular expansion.

Thus, the need exists to improve the efficiency of T cell harvest and ability to grow larger amounts of immune effector cells to generate clinical grade manufactured product.

SUMMARY OF THE INVENTION

The present disclosure pertains, at least in part, to methods for improving the efficacy and/or expansion (e.g., ex vivo expansion) of immune effector cells (e.g., T cells, NK cells) for use in cellular therapy. In some embodiments, Applicants have discovered a significant benefit to acquiring, e.g., harvesting, immune cells from a subject, e.g., a cancer patient, as early as possible after diagnosis (e.g., prior to a therapy, or at an earlier time point during the course of a therapy). Some embodiments described herein provide a criterion for evaluating and/or optimizing the suitability of an immune cell for use in cellular therapy, e.g., Chimeric Antigen Receptor (CAR)-therapy. Without wishing to be bound by theory, it is thought that immune cells harvested as early as possible after diagnosis, or after treatment with selected chemotherapy, include a population of less differentiated immune effector cells (e.g., naïve and early memory T cells). It is thought that populations of less differentiated immune effector cells have a higher proliferative, self-renewal, and/or survival capacity and thus have a higher expansion capability and/or a higher anti-tumor efficacy.

Accordingly, in embodiments, the methods disclosed herein advantageously improve T cell fitness (e.g., suitability for use in cellular therapy) and efficacy by acquiring cells from subjects early after diagnosis of a cancer, e.g., prior to chemotherapy or prior to certain/multiple chemotherapeutic cycles. In embodiments, the methods disclosed herein utilize cells acquired from a patient prior to a chemotherapeutic cycle containing T cell-depleting drugs (e.g., acquired prior to 2, 3, 4, or 5 cycles of chemotherapy), or acquired prior to delayed intensification or consolidation cycles. In other embodiments, the methods optimize expansion capability and/or anti-tumor efficacy of the immune cells by including patient selection, e.g., based on type of malignancy (e.g., leukemia versus lymphoma) or severity of disease (e.g., standard-, high-, or very high-risk). In yet other embodiments, the methods optimize expansion capability and/or anti-tumor efficacy of the immune cells by including cell selection, e.g., selection of cell populations having a higher absolute T cell count, or a higher percentage of less differentiated T cells. Thus, the methods disclosed herein can be used to optimize one or more of compositions and methods for cellular therapy, and/or methods of making immune effector cell populations (e.g., CAR-expressing cells).

Accordingly, in one aspect, the invention features a method for evaluating the suitability of an immune cell (e.g., an immune effector cell or a population thereof), for use in cellular therapy, e.g., CAR therapy (e.g., a cancer therapy). The method includes acquiring a value for one, two, three, four or more (all) of the following:
  (i) the timing of immune cell acquisition (e.g., harvest) from a subject (e.g., a cancer patient);
  (ii) the timing of a therapy, e.g., a chemotherapy, e.g., in relation to the immune cell acquisition (e.g., harvest);
  (iii) the type of therapy, e.g., chemotherapy;
  (iv) the underlying malignancy;
  (v) an immune cell (e.g., T cell) parameter, e.g., one or more of T cell number, T cell phenotype or T cell function,
  or a combination of (i)-(v),
  wherein the value of any of (i)-(v) is indicative of the suitability of the immune cell for use in the cellular therapy, e.g., the CAR therapy. In one embodiment, the value of any of (i)-(v) is indicative of one or more of: capability for expansion (e.g., ex-vivo expansion) of the immune cell, the efficacy of the immune cell for therapy, or the yield of the immune cell.

In another aspect, the invention features a method of treating, or providing anti-tumor immunity to, a subject having a cancer. The method includes administering to the subject an effective amount of an immune cell (e.g., an immune effector cell or a population thereof) that is capable of expressing a CAR molecule (a "CAR-expressing cell" or a "CAR therapy"), in combination with a therapy, e.g., a chemotherapy. In certain embodiments, the immune cell (e.g., an immune effector cell or a population thereof) is acquired (e.g., obtained or harvested) by optimizing, one, two, three, four, or more (all) of the following:
  (i) the timing of immune cell acquisition (e.g., harvest) from a subject (e.g., a cancer patient);
  (ii) the timing of a therapy, e.g., a chemotherapy, e.g., in relation to the immune cell acquisition (e.g., harvest);
  (iii) the type of therapy, e.g., chemotherapy;
  (iv) the underlying malignancy;

(v) an immune cell (e.g., T cell) parameter, e.g., one or more of T cell number, T cell phenotype or T cell function,
or a combination of (i)-(v).

In one embodiment, the immune cell is acquired prior to introduction of the CAR molecule. In one embodiment, the acquired immune cell is expanded prior to introduction of the CAR molecule. In other embodiments, the immune cell is acquired after introduction of the CAR molecule. In one embodiment, the acquired immune cell is expanded after introduction of the CAR molecule. The immune cell can be expanded and/or activated according to any of the methods described herein.

In embodiments, the immune cell shows an increase in one or more of: expansion (e.g., ex-vivo expansion) of the immune cell population, the efficacy of the immune cell population for therapy, or the yield of the immune cell population, when any of (i)-(v) are optimized.

In some embodiments, the method comprises introducing into the acquired immune cell (e.g., cell population) a nucleic acid encoding a CAR, e.g., a CAR molecule described herein, e.g., a CD19 CAR described herein (e.g., CTL019).

In yet another aspect, the invention features a method of enriching for, or making, an immune cell population (e.g., an immune effector cell population) suitable for use in a CAR therapy (e.g., a cell that expresses a CAR molecule). The method includes acquiring (e.g., harvesting) the immune cell population, according to one, two, three, four, or more (all) of the following:
    (i) the timing of immune cell acquisition (e.g., harvest) from a subject (e.g., a cancer patient);
    (ii) the timing of a therapy, e.g., a chemotherapy, e.g., in relation to the immune cell acquisition (e.g., harvest);
    (iii) the type of therapy, e.g., chemotherapy;
    (iv) the underlying malignancy;
    (v) an immune cell (e.g., T cell) parameter, e.g., one or more of T cell number, T cell phenotype or T cell function,
    or a combination of (i)-(v).

In one embodiment, the immune cell population is acquired prior to introduction of the CAR molecule. In one embodiment, the acquired immune cell is expanded prior to introduction of the CAR molecule. In other embodiments, the immune cell is acquired after introduction of the CAR molecule. In one embodiment, the acquired immune cell is expanded after introduction of the CAR molecule. The immune cell can be expanded and/or activated according to any of the methods described herein.

In embodiments, the immune cell population shows an increase in one or more of: the expansion (e.g., ex-vivo expansion) of the immune cell population, the efficacy of the immune cell population for therapy, or the yield of the immune cell population, when any of (i)-(v) are optimized.

In some embodiments, the method further comprises introducing into the immune cell (e.g., cell population) a nucleic acid encoding a CAR, e.g., a CAR molecule described herein, e.g., a CD19 CAR described herein (e.g., CTL019).

In another aspect, the invention features an immune cell preparation or reaction mixture, e.g., comprising a population of immune effector cells (e.g., comprising a CAR molecule or a nucleic acid encoding a CAR molecule), made according to the methods described herein.

Additional features or embodiments of any of the aforesaid methods, preparations, and reaction mixtures include one or more of the following:

Subjects

In one embodiment, the subject, e.g., the subject from which immune cells are acquired and/or the subject to be treated, is a human, e.g., a cancer patient. In certain embodiments, the subject is 18 years of age of younger (e.g., 18, 17, 16, 15, 14, 13, 12, 11, 10, 9, 8, 7, 6, 5, 4, 3, 2, 1 or younger (e.g., 12 months, 6 months, 3 months or less)). In one embodiment, the subject is a pediatric cancer patient.

In other embodiments, the subject is an adult, e.g., the subject is older than 18 years of age (e.g., older than 18, 19, 20, 25, 30, 35, 40, 45, 50, 55, 60, 65, 70, 75, 80, or older). In one embodiment, the subject is an adult cancer patient.

In certain embodiments, the subject has a disease associated with expression of a tumor- or cancer associated-antigen, e.g., a disease as described herein. In one embodiment, the subject has a cancer, e.g., a cancer as described herein.

In one embodiment, the subject has a cancer that is chosen from a hematological cancer, a solid tumor, or a metastatic lesion thereof. Exemplary cancers include, but are not limited to, B-cell acute lymphocytic leukemia (B-ALL), T-cell acute lymphocytic leukemia (T-ALL), acute lymphocytic leukemia (ALL), chronic myelogenous leukemia (CML), chronic lymphocytic leukemia (CLL), B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma (NHL), Hodgkin's lymphoma (HL), plasmablastic lymphoma, plasmacytoid dendritic cell neoplasm, and Waldenstrom macroglobulinemia. In one embodiment, the cancer is ALL. In another embodiment, the cancer is CLL.

In embodiments, the subject has a leukemia, e.g., ALL. In embodiments, the subject has leukemia, e.g., ALL, and is a pediatric patient, e.g., is 18 years of age of younger (e.g., 18, 17, 16, 15, 14, 13, 12, 11, 10, 9, 8, 7, 6, 5, 4, 3, 2, 1 or younger (e.g., 12 months, 6 months, 3 months or less)).

In an embodiment, the subject has ALL, e.g., is classified as having standard-risk, high-risk, or very high-risk ALL. In an embodiment, the subject has ALL, e.g., is classified as having standard-risk, high-risk, or very high-risk ALL and is a pediatric subject, e.g., is 18 years of age of younger. In one embodiment, the subject is classified as having standard-risk ALL. In embodiments, the subject is classified as having standard-risk ALL and is a pediatric subject, e.g., is 18 years of age of younger. In another embodiment, the subject is not classified as having high-risk or very high-risk ALL. In embodiments, the subject is not classified as having high-risk or very high-risk ALL and is a pediatric subject, e.g., is 18 years of age of younger.

In embodiments, the subject does not have a lymphoma, e.g., the subject does not have Non-Hodgkin lymphoma (NHL). In embodiments, the subject is a pediatric subject, e.g., is 18 years of age of younger and does not have NHL.

In other embodiments, the subject has a lymphoma, e.g., NHL. In embodiments, the subject is a pediatric subject, e.g., is 18 years of age of younger and has NHL.

In embodiments, the subject does not have a relapsed cancer. In embodiments, the subject is a pediatric subject, e.g., is 18 years of age of younger and does not have a relapsed cancer. In other embodiments, the subject has a relapsed cancer. In embodiments, the subject is a pediatric subject, e.g., is 18 years of age of younger and has a relapsed cancer.

In one embodiment, the immune cell (e.g., the population of immune effector cells) is acquired, e.g., obtained, from a subject having a haematological cancer, e.g., a leukemia, e.g., CLL, ALL, or a lymphoma, e.g., MCL, NHL, or HL.

Timing of Harvest/Administration of Chemotherapy

In certain embodiments, early timing of immune cell acquisition, e.g., harvest (e.g., after diagnosis) is indicative of an increased suitability of the immune cell for use in cellular therapy, e.g., the CAR therapy. In embodiments, early timing of immune cell harvest increases the capability for one or more of: the expansion (e.g., ex-vivo expansion) of the immune cell, the adequacy of immune cell for therapy, or the manufacturing yield of the immune cell.

In one embodiment, harvesting the immune cell prior to administration of a therapy, e.g., a chemotherapy, to the subject results in increased suitability of the immune cell for use in cellular therapy, e.g., CAR therapy. In other embodiments, harvesting the immune cell early during the course of a therapy, e.g., a chemotherapy (e.g., before the subject has undergone 2, 3, 4 or 5 cycles of chemotherapy), to the subject results in increased suitability of the immune cell for use in cellular therapy, e.g., CAR therapy.

In embodiments of the methods disclosed herein, the immune cell harvest occurs prior to administration of a therapy, e.g., a chemotherapy, to the subject. In embodiments, the harvest occurs early during the course of a therapy, e.g., a chemotherapy, to the subject. In an embodiment, immune cell harvest occurs before the subject has undergone 2, 3, 4 or 5 cycles of chemotherapy. In an embodiment, the immune cell harvest occurs after the subject has undergone 1 cycle of chemotherapy, but before the subject has undergone more than 1 cycle (e.g., more than 1, 2, 3, 4, or 5 cycles) of chemotherapy.

In certain embodiments, the chemotherapy or cycle of chemotherapy includes one or more of an induction, a consolidation, an interim maintenance, a delayed intensification, or a maintenance therapy cycle. In one embodiment, the immune effector cells are harvested from the subject before the subject has undergone a consolidation cycle of chemotherapy or an induction cycle of chemotherapy. In embodiments, the cells are harvested before the subject has undergone a consolidation cycle of chemotherapy. In embodiments, the subject is classified as having a high-risk or very high-risk cancer (e.g., ALL) and the cells are harvested before the subject has undergone a consolidation cycle. In another embodiment, the immune effector cells are harvested from the subject before the subject has undergone a delayed intensification cycle. In embodiments, the subject is classified as having a standard-risk cancer (e.g., ALL) and the cells are harvested before the subject has undergone a delayed intensification cycle. In embodiments, the chemotherapy cycle(s) are chosen from Table 8.

In some embodiments, the chemotherapy comprises a drug chosen from Table 8. In embodiments, the chemotherapy comprises a drug and dosing regimen described in Table 8. In embodiments, the chemotherapy can include vincristine, dexamethasone, PEG-L-asparaginase, daunorubicin, 6-mercaptopurine, cyclophosphamide, cytarabine, methotrexate, doxorubicin, 6-thioguanine, and/or prednisone.

In some embodiments, the immune effector cells are harvested from the subject before the subject has been administered cyclophosphamide and/or cytarabine.

Immune Effector Cell Parameters

In some embodiments, the harvested immune effector cells include a higher number of less differentiated T cells, e.g., a higher number of one or more of naïve T cells, stem central memory T cells, and/or central memory T cells, e.g., compared to a reference value (e.g., a sample from the subject at a later time point or after exposure to additional rounds of chemotherapy). In some embodiments, the harvested immune effector cells include at least 20% naïve T cells, at least 2% stem central memory T cells, and/or at least 4% central memory T cells.

In other embodiments, an increased absolute T cell count (ATC) is indicative of increased suitability of the immune cell for use in cellular therapy, e.g., CAR therapy. In one embodiment, the harvested immune effector cells comprise an absolute T cell count of at least 400 cells/microliter, an absolute naïve T cell count of at least 200 cells/microliter, an absolute stem central memory T cell count of at least 20 cells/microliter, and/or an absolute central memory T cell count of at least 40 cells/microliter.

In embodiments, the population of immune effector cells is selected based upon the expression of one or more markers, e.g., CCR7, CD62L, CD45RO, and CD95, e.g., the population of immune effector cells (e.g., T cells) are CCR7+ and CD62L+.

In embodiments, the naïve T cells are identified based upon an expression pattern of CCR7+, CD62L+, CD45RO−, CD95−, wherein the stem central memory T cells are identified based upon an expression pattern of CCR7+, CD62L+, CD45RO−, CD95+, and wherein the central memory T cells are identified based upon an expression pattern of CCR7+, CD62L+, CD45RO+, CD95+.

CAR Molecules

In accordance with the methods, preparations, and reaction mixtures described herein, an immune effector cell, e.g., obtained by a method described herein, can be engineered to contain a CAR molecule (also referred to herein as "CAR") that targets one or more cancer associated antigens. In some embodiments, the cancer associated antigen (tumor antigens) is chosen from one or more of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bD-Galp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CALX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlep(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

In one embodiment, the cancer associated antigen targeted by the CAR molecule is CD19, e.g., a CD19 CAR described herein (e.g., CTL019). In one embodiment, the CD19 CAR comprises the amino acid, or has the nucleotide sequence shown in Table 4.

In one embodiment, the cancer associated antigen targeted by the CAR molecule is BCMA, e.g., an anti-BCMA CAR described herein. In one embodiment, the anti-BCMA CAR comprises an amino acid, or has a nucleotide sequence shown in Table 11.

In an embodiment, the cancer associated antigen targeted by the CAR molecule is EGFRvIII, e.g., an anti-EGFRvIII CAR described herein, e.g., described in US2014/0322275A1, incorporated herein by reference. In embodiments, the anti-EGFRvIII CAR comprises an amino acid, or has a nucleotide sequence shown in US2014/0322275A1, incorporated herein by reference.

In an embodiment, the cancer associated antigen targeted by the CAR molecule is CD123, e.g., an anti-CD123 CAR described herein, e.g., described in US2014/0322212A1 or US2016/0068601A1, both incorporated herein by reference. In embodiments, the anti-CD123 CAR comprises an amino acid, or has a nucleotide sequence shown in US2014/0322212A1 or US2016/0068601A1, both incorporated herein by reference.

In an embodiment, the cancer associated antigen targeted by the CAR molecule is mesothelin, e.g., an anti-mesothelin CAR described herein, e.g., described in WO 2015/090230, incorporated herein by reference. In embodiments, the anti-mesothelin CAR comprises an amino acid, or has a nucleotide sequence shown in WO 2015/090230, incorporated herein by reference.

In an embodiment, the cancer associated antigen targeted by the CAR molecule is mesothelin, e.g., an anti-CLL1 CAR described herein, e.g., described in US2016/0051651A1, incorporated herein by reference. In embodiments, the anti-CLL1 CAR comprises an amino acid, or has a nucleotide sequence shown in US2016/0051651A1, incorporated herein by reference.

In an embodiment, the cancer associated antigen targeted by the CAR molecule is mesothelin, e.g., an anti-CD33 CAR described herein, e.g., described in US2016/0096892A1, incorporated herein by reference. In embodiments, the anti-CD33 CAR comprises an amino acid, or has a nucleotide sequence shown in US2016/0096892A1, incorporated herein by reference. In some embodiments, the antigen binding domain of the CAR molecule comprises an antibody, an antibody fragment, an scFv, a Fv, a Fab, a (Fab')2, a single domain antibody (SDAB), a VH or VL domain, or a camelid VHH domain.

In some embodiments, the transmembrane domain of the CAR molecule comprises a transmembrane domain chosen from the transmembrane domain of an alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C.

In certain embodiments, the transmembrane domain of the CAR molecule comprises an amino acid sequence of a CD8 transmembrane domain having at least one, two or three modifications but not more than 20, 10 or 5 modifications of an amino acid sequence of SEQ ID NO: 6, or a sequence with 95-99% identity to an amino acid sequence of SEQ ID NO: 6. In one embodiment, the transmembrane domain comprises the sequence of SEQ ID NO: 6.

In other embodiments, nucleic acid sequence encoding the CD8 transmembrane domain comprises the sequence of SEQ ID NO: 17, or a sequence with 95-99% identity thereof.

In certain embodiments, the antigen binding domain is connected to the transmembrane domain by a hinge region. In one embodiment, the hinge region comprises the amino acid sequence of a CD8 hinge, e.g., SEQ ID NO: 2; or the amino acid sequence of an IgG4 hinge, e.g., SEQ ID NO: 36, or a sequence with 95-99% identity to SEQ ID NO:2 or 36. In other embodiments, the nucleic acid sequence encoding the hinge region comprises a sequence of SEQ ID NO: 13 or SEQ ID NO: 37, corresponding to a CD8 hinge or an IgG4 hinge, respectively, or a sequence with 95-99% identity to SEQ ID NO:13 or 37.

In other embodiments, the CAR comprises an intracellular signaling domain, e.g., a primary signaling domain and/or a costimulatory signaling domain. In some embodiments, the intracellular signaling domain comprises a primary signaling domain. In some embodiments, the intracellular signaling domain comprises a costimulatory signaling domain. In some embodiments, the intracellular signaling domain comprises a primary signaling domain and a costimulatory signaling domain.

In certain embodiments, the primary signaling domain comprises a functional signaling domain of a protein selected from the group consisting of CD3 zeta, CD3 gamma, CD3 delta, CD3 epsilon, common FcR gamma (FCER1G), FcR beta (Fc Epsilon R1b), CD79a, CD79b, Fcgamma RIIa, DAP10, and DAP12.

In one embodiment, the primary signaling domain of the CAR molecule comprises a functional signaling domain of CD3 zeta. The CD3 zeta primary signaling domain can comprise an amino acid sequence having at least one, two or three modifications but not more than 20, 10 or 5 modifications of an amino acid sequence of SEQ ID NO: 9 or SEQ ID NO: 10, or a sequence with 95-99% identity to an amino acid sequence of SEQ ID NO:9 or SEQ ID NO: 10. In some embodiments, the primary signaling domain comprises a sequence of SEQ ID NO:9 or SEQ ID NO: 10. In other embodiments, the nucleic acid sequence encoding the primary signaling domain comprises a sequence of SEQ ID NO:20 or SEQ ID NO: 21, or a sequence with 95-99% identity thereof.

In some embodiments, the intracellular signaling domain of the CAR molecule comprises a costimulatory signaling domain. For example, the intracellular signaling domain can comprise a primary signaling domain and a costimulatory signaling domain. In some embodiments, the costimulatory signaling domain comprises a functional signaling domain of a protein chosen from one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D.

In certain embodiments, the costimulatory signaling domain of the CAR molecule comprises an amino acid sequence having at least one, two or three modifications but not more than 20, 10 or 5 modifications of an amino acid sequence of SEQ ID NO:7 or SEQ ID NO: 16, or a sequence with 95-99% identity to an amino acid sequence of SEQ ID NO:7 or SEQ ID NO: 16. In one embodiment, the costimulatory signaling domain comprises a sequence of SEQ ID NO: 7 or SEQ ID NO: 16. In other embodiments, the nucleic acid sequence encoding the costimulatory signaling domain comprises a sequence of SEQ ID NO:18 or SEQ ID NO: 15, or a sequence with 95-99% identity thereof.

In other embodiments, the intracellular domain of the CAR molecule comprises the sequence of SEQ ID NO: 9 or SEQ ID NO: 10, and the sequence of SEQ ID NO: 7 or SEQ ID NO: 16, wherein the amino acid sequence(s) comprising the intracellular signaling domain are expressed in the same frame and as a single polypeptide chain.

In certain embodiments, the nucleic acid sequence encoding the intracellular signaling domain comprises a sequence of SEQ ID NO:18 or SEQ ID NO: 15, or a sequence with 95-99% identity thereof, and a sequence of SEQ ID NO:20 or SEQ ID NO:21, or a sequence with 95-99% identity thereof.

In some embodiments, the CAR further comprises a leader sequence. In one embodiment, the leader sequence comprises the sequence of SEQ ID NO: 1.

In certain embodiments, the antigen binding domain of the CAR molecule has a binding affinity KD of $10^{-4}$ M to $10^{-8}$ M.

In one embodiment, the antigen binding domain of the CAR molecule is an antigen binding domain described herein, e.g., an antigen binding domain described herein for a target provided above.

In some embodiments, the CAR comprises a CD19 CAR, e.g., a CD19 CAR described herein. In embodiments, the CD19 CAR comprises an antigen binding domain described herein, e.g., in Table 1 or 4.

Methods of Treatment/Combination Therapies

In accordance with methods of treating a disorder as described herein (e.g., a cancer) and providing anti-tumor immunity described herein, in some embodiments, the method comprises administering to a subject a CAR molecule, or a population of immune effector cells made by a method described herein. In some embodiment the population of immune effector cells is engineered to express a CAR molecule, e.g. a CAR described herein, e.g., a CD19 CAR described herein. In embodiments, the method further comprises administering a therapy, e.g., a chemotherapy described herein, to the subject.

Also provided herein is a composition comprising an immune effector cell (e.g., a population of immune effector cells) that comprises a CAR molecule (e.g., a CAR molecule as described herein) for use in the treatment of a subject having a disease associated with expression of a tumor antigen, e.g., a disorder as described herein.

In some embodiments, the chemotherapy (e.g., cycle of chemotherapy) and the CAR therapy are administered concurrently. In other embodiments, the chemotherapy (e.g., cycle of chemotherapy) and the CAR therapy are administered sequentially, e.g., one after the other. In embodiments, there is less than 1 week (e.g., less than 7, 6, 5, 4, 3, 2, or 1 day) of overlap in administration of the chemotherapy (e.g., cycle of chemotherapy) and the CAR therapy. In embodiments, there is at least 1 week (e.g., at least 1, 2, 3, 4, 5 weeks, 1, 2, 3, 4, 5, 6 months or more) of overlap in administration of the chemotherapy (e.g., cycle of chemotherapy) and the CAR therapy.

In some embodiments, the CAR therapy is administered before the chemotherapy, e.g., before a cycle of chemotherapy. In embodiments, the CAR therapy is administered before a first cycle, second cycle, third cycle, fourth cycle, or fifth cycle of chemotherapy. In embodiments, the CAR therapy is administered before an induction cycle, consolidation cycle, interim maintenance cycle, delayed intensification cycle, or maintenance cycle of chemotherapy. In embodiments, the CAR therapy is administered before a chemotherapy, e.g., cycle of chemotherapy, comprising a drug described herein, e.g., a drug described in Table 8. In embodiments, administration of the CAR therapy starts before administration of a chemotherapy, e.g., before a cycle of chemotherapy, and then administration of the CAR therapy and the chemotherapy continue concurrently for a period of time.

In embodiments, the CAR therapy is administered after the chemotherapy, e.g., after a cycle of chemotherapy. In embodiments, the CAR therapy is administered after a first cycle, second cycle, third cycle, fourth cycle, or fifth cycle of chemotherapy. In embodiments, the CAR therapy is administered after an induction cycle, consolidation cycle, interim maintenance cycle, delayed intensification cycle, or maintenance cycle of chemotherapy. In embodiments, the CAR therapy is administered after a chemotherapy, e.g., cycle of chemotherapy, comprising a drug described herein, e.g., a drug described in Table 8. In embodiments, administration of the CAR therapy starts after administration of a chemotherapy, e.g., after a cycle of chemotherapy, and then administration of the CAR therapy and the chemotherapy continue concurrently for a period of time.

In one embodiment, the cancer is a hematological cancer such as, e.g., ALL or CLL. In one embodiment, the cancer, e.g., a hematological cancer described herein, such as, e.g., a leukemia (e.g., ALL or CLL) or a lymphoma (e.g., MCL, HL, or NHL).

In one embodiment, a disease associated with a tumor antigen, e.g., a tumor antigen described herein, e.g., CD19, is selected from a proliferative disease such as a cancer or malignancy or a precancerous condition such as a myelodysplasia, a myelodysplastic syndrome or a preleukemia, or is a non-cancer related indication associated with expression of a tumor antigen described herein. In one embodiment, the disease is a cancer described herein, e.g., a cancer described herein as being associated with a target described herein. In one embodiment, the hematologic cancer is leukemia. In one embodiment, the cancer is selected from the group consisting of one or more acute leukemias including but not limited to B-ALL, T-ALL, ALL; one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and/or "preleukemia" (e.g., a diverse collection of hematological conditions united by ineffective production (or dysplasia) of myeloid blood cells). In certain embodiment, a disease associated with expression of a tumor antigen described herein includes, but is not limited to, atypical and/or non-classical cancers, malignancies, precancerous conditions or proliferative diseases expressing a tumor antigen as described herein; and any combination thereof.

In embodiments, the disease associated with expression of the tumor antigen is selected from the group consisting of a proliferative disease, a precancerous condition, a cancer, and a non-cancer related indication associated with expression of the tumor antigen.

In another embodiment, the disease associated with a tumor antigen described herein is a solid tumor. In embodiments, the cancer is chosen from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In certain embodiments of any of the aforesaid methods or uses, the tumor antigen associated with the disease is chosen from one or more of: CD19, CD123, CD22, CD30, CD171, CS-1, CLL-1 (CLECL1), CD33, EGFRvIII, GD2, GD3, BCMA, Tn Ag, PSMA, ROR1, FLT3, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, FAP, IGF-I receptor, CALX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, legumain, HPV E6, E7, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, and IGLL1.

In one embodiment, the population of cells are autologous to the subject administered the population. In one embodiment, the population of cells is allogeneic to the subject administered the population. In one embodiment, the subject is a human.

In one embodiment, the population of immune effector cells transduced with a nucleic acid encoding a CAR, e.g., a CAR described herein, e.g., a CD19 CAR described herein, are expanded, e.g., by a method described herein. In one embodiment, the cells are expanded for a period of 8 days or less, e.g., 7, 6, 5, 4, or 3 days. In one embodiment, the cells, e.g., a CD19 CAR cell described herein, are expanded in culture for 5 days, and the resulting cells are more potent than the same cells expanded in culture for 9 days under the same culture conditions, e.g., as described herein.

In one embodiment, the subject is administered $10^4$ to $10^6$ immune effector cells per kg body weight of the subject. In one embodiment, the subject receives an initial administration of a population of immune effector cells (e.g., an initial administration of $10^4$ to $10^6$ immune effector cells per kg body weight of the subject, e.g., $10^4$ to $10^5$ immune effector cells per kg body weight of the subject), a plurality of which comprise the nucleic acid encoding a CAR, e.g., a CAR described herein, e.g., a CD19 CAR described herein, and one or more subsequent administrations of a population of immune effector cells (e.g., one or more subsequent administration of $10^4$ to $10^6$ immune effector cells per kg body weight of the subject, e.g., $10^4$ to $10^5$ immune effector cells per kg body weight of the subject), a plurality of which comprise a nucleic acid encoding a CAR, e.g., a CAR described herein, e.g., a CD19 CAR described herein. In one embodiment, the one or more subsequent administrations are administered less than 15 days, e.g., 14, 13, 12, 11, 10, 9, 8, 7, 6, 5, 4, 3, or 2 days after the previous administration, e.g., less than 4, 3, 2 days after the previous administration. In one embodiment, the subject receives a total of about $10^6$ immune effector cells per kg body weight of the subject over the course of at least three administrations of a population of immune effector cells, e.g., the subject receives an initial dose of $1\times10^5$ immune effector cells, a second administration of $3\times10^5$ immune effector cells, and a third administration of $6\times10^5$ immune effector cells, and, e.g., each administration is administered less than 4, 3, 2 days after the previous administration.

In certain embodiments, the methods or uses are carried out in combination with an agent that increases the efficacy of the immune effector cell, e.g., an agent as described herein.

Further Embodiments of the Methods, Preparations, and Reaction Mixtures

In accordance with the methods of treating and/or making, preparations, and reaction mixtures described herein, in embodiments, the method further comprises removing T regulatory cells, e.g., CD25+ T cells, from the immune cell population, e.g., to thereby provide a population of T regulatory-depleted cells, e.g., CD25+ depleted cells, that are suitable for expression of a CAR.

In one embodiment, the population of T regulatory-depleted cells contains less than 30%, 25%, 20%, 15%, 10%, 5%, 4%, 3%, 2%, 1% of CD25+ cells.

In one embodiment, the immune cell population includes cells of a subject having cancer, e.g., a subject having a CD25 expressing cancer such as, e.g., chronic lymphocytic leukemia (CLL). In one embodiment, the population of T regulatory-depleted cells contains less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of tumor cells.

In one embodiment, the immune cell population is autologous to the subject who the cells will be administered to for treatment. In one embodiment, the population of immune effector cells are allogeneic to the subject who the cells will be administered for treatment.

In one embodiment, the T regulatory cells, e.g., CD25+ T cells, are removed from the population using an anti-CD25 antibody, or fragment thereof, or a CD25-binding ligand, e.g. IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Militenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL.

In one embodiment, the population of T regulatory-depleted cells, e.g., CD25+ depleted cells, are suitable for expression of a CAR described herein, e.g., a CD19 CAR described herein. In one embodiment, the population of T regulatory-depleted cells contains less than 30%, 25%, 20%, 15%, 10%, 5%, 4%, 3%, 2%, 1% of the leukemia cells, e.g., CLL cells, ALL cells, or lymphoma cells, e.g., MCL cells, NHL cells, or HL cells. In one embodiment, the population of immune effector cells are obtained from a subject having CLL, and the population of T regulatory-depleted cells, e.g., CD25+ depleted cells, contains less than 30%, 25%, 20%, 15%, 10%, 5%, 4%, 3%, 2%, 1% of the leukemia cells, e.g., CLL cells and are suitable for expression of a CD19 CAR described herein. In one embodiment, the population of T regulatory-depleted cells contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the population of T regulatory-depleted cells contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In embodiments, the immune effector cells are harvested from blood, e.g., peripheral blood, of the subject.

In one embodiment, the population of immune effector cells are T cells isolated from peripheral blood lymphocytes. In an embodiment, the population of T cells are obtained by lysing the red blood cells and/or by depleting the monocytes. In an embodiment, the population of T cells is isolated from peripheral lymphocytes using, e.g., a method described herein.

In one embodiment, the population of immune effector cells can be obtained from a blood sample from a subject, e.g., obtained by apheresis. In one embodiment, the cells collected by apheresis are washed to remove the plasma fraction and, optionally, the cells are provided in an appropriate buffer or media for subsequent processing steps. In one embodiment, the cells are washed with a buffer such as, e.g., phosphate buffered saline (PBS). In an embodiment, the cells are washed in a wash solution that lacks one or more divalent cation such as calcium and magnesium. In one embodiment, the cells are washed in a buffer that has substantially no divalent cations.

In embodiments, the immune effector cells are harvested from the blood by using density centrifugation.

In one embodiment, the method of making further comprises removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

In one embodiment, the method of making further comprises removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

In one embodiment, the method further comprises removing cells from the population which express CD14, to thereby provide a population of T regulatory-depleted, e.g., CD25+ depleted cells, and CD14+ depleted cells. In one embodiment, CD14+ cells are removed simultaneously with the T regulatory, e.g., CD25+ cells. For example, an anti-CD25 antibody, or fragment thereof, and an anti-CD14 antibody, or fragment thereof, can be attached to the same bead which can be used to remove the cells; or an anti-CD25 antibody, or fragment thereof, and the anti-CD14 antibody, or fragment thereof, can be attached to separate beads, a mixture of which can be used to remove the cells. In other embodiments, the removal of T regulatory cells, e.g., CD25+ cells, and the removal of the CD14+ cells is sequential, and can occur, e.g., in either order.

In one embodiment, the population of immune effector cells provided have been selected based upon the expression of one or more markers, e.g., CD3, CD28, CD4, CD8, CD27, CD127, CD45RA, and CD45RO, e.g., the provided population of immune effector cells (e.g., T cells) are CD3+ and/or CD28+.

In one embodiment, the method further comprises obtaining a population of immune effector cells, e.g., T cells, enriched for the expression of one or more markers, e.g., CD3, CD28, CD4, CD8, CD27, CD127, CD45RA, and CD45RO. In an embodiment, population of immune effector cells are enriched for CD3+ and/or CD28+ cells. For example, T cells isolated by incubation with anti-CD3/anti-CD28 conjugated beads are obtained. In one embodiment, the method further comprises selecting cells from the population of T regulatory-depleted cells, e.g., CD25+ depleted cells, which express one or more markers, e.g., CD3, CD28, CD4, CD8, CD45RA, and CD45RO.

In one embodiment, the method further comprises activating the population of T regulatory depleted cells, e.g., CD25+ depleted cells, e.g., by a method described herein.

In embodiments, the method further comprises transducing a cell from the immune effector cell population with a vector comprising a nucleic acid encoding a CAR, e.g., a CAR described herein, e.g., a CD19 CAR described herein. In embodiments, the method further comprises expanding the immune effector cell population, e.g., engineered to express a CAR, e.g., a CAR described herein, e.g., a CD19 CAR described herein, e.g., by a method described herein. In embodiments, the population of cells is expanded in the presence a cytokine, e.g., IL-15 and/or IL-7 (e.g., IL-15 and IL-7).

In one embodiment, the method of making further comprises transducing a cell from the population of T regulatory-depleted cells, e.g., the population of CD25+ depleted cells, with a vector comprising a nucleic acid encoding a CAR, e.g., a CAR described herein, e.g., a CD19 CAR described herein. In one embodiment, the vector is selected from the group consisting of a DNA, a RNA, a plasmid, a lentivirus vector, adenoviral vector, or a retrovirus vector. In one embodiment, the cell from the population of T regulatory-depleted cells, e.g., the population of CD25+ depleted cells, is transduced with a vector once, e.g., within one day after population of immune effector cells are obtained from a blood sample from a subject, e.g., obtained by apheresis.

In one embodiment, the method further comprises generating a population of RNA-engineered cells transiently expressing exogenous RNA from the population of T regulatory-depleted cells, e.g., the population of CD25+ depleted cells. The method comprises introducing an in vitro transcribed RNA or synthetic RNA into a cell from the population, where the RNA comprises a nucleic acid encoding a CAR, e.g., a CAR described herein, e.g., a CD19 CAR described herein.

In one embodiment, cells transduced with a nucleic acid encoding a CAR, e.g., a CAR described herein, e.g., a CD19 CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6, 5, 4, or 3 days. In one embodiment, the cells, e.g., a CD19 CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CD19 CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CD19 CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CD19 CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one embodiment, the cells are expanded by culturing the cells in the presence of an agent that stimulates a CD3/TCR complex associated signal and a ligand that stimulates a costimulatory molecule on the surface of the cells, e.g., as described herein. In one embodiment, the agent is a bead conjugated with anti-CD3 antibody, or a fragment thereof, and/or anti-CD28 antibody, or a fragment thereof.

In one embodiment, the cells are expanded in an appropriate media (e.g., media described herein) that may, optionally, contain one or more factor for proliferation and/or viability, including serum (e.g., fetal bovine or human serum), interleukin-2 (IL-2), insulin, IFN-γ, IL-4, IL-7, GM-CSF, IL-10, IL-12, IL-15, IL-21, TGFβ, and TNF-α or any other additives for the growth of cells.

In one embodiment, the cells are expanded in an appropriate media (e.g., media described herein) that includes one or more interleukins that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence IL-15 and/or IL-7 (e.g., IL-15 and IL-7).

In one embodiment, the cells are cryopreserved after the appropriate expansion period. In one embodiment, the cells are cryopreserved according to a method described herein. In one embodiment, the expanded cells are cryopreserved in an appropriate media, e.g., an infusible media, e.g., as described herein.

In one embodiment, the method of making further comprises contacting the population of immune effector cells with a nucleic acid encoding a telomerase subunit, e.g., hTERT. In an embodiment, the nucleic acid is DNA or RNA.

In one embodiment, the method further comprises, prior to expansion, removing T regulatory cells, e.g., CD25+ T cells, from the population, to thereby provide a population of T regulatory-depleted cells, e.g., CD25+ depleted cells to be expanded. In one embodiment, the T regulatory cells, e.g., CD25+ cells, are removed by a method described herein.

In one embodiment, the method further comprises, prior to expansion, removing T regulatory cells, e.g., CD14+ cells, from the population, to thereby provide a population of CD14+ depleted cells to be expanded. In one embodiment, the T regulatory cells, e.g., CD14+ cells, are removed by a method described herein.

In one embodiment, the method further comprises contacting the population of immune effector cells with a nucleic acid encoding a telomerase subunit, e.g., hTERT. In an embodiment, the nucleic acid is DNA or RNA.

In embodiments, the method comprises contacting the population of immune effector cells with a nucleic acid encoding a CAR, and a nucleic acid encoding a telomerase subunit, e.g., hTERT, under conditions that allow for CAR and telomerase expression.

In an embodiment, the nucleic acid encoding the telomerase subunit is RNA. In another embodiment, the nucleic acid encoding the telomerase subunit is DNA. In an embodiment, the nucleic acid encoding the telomerase subunit comprises a promoter capable of driving expression of the telomerase subunit.

In embodiments, the method of making comprises contacting the population of immune effector cells with a nucleic acid encoding a CAR and an RNA encoding a telomerase subunit, e.g., hTERT, under conditions that allow for CAR and telomerase expression.

In an embodiment, the nucleic acid encoding the CAR and the RNA encoding the telomerase subunit are part of the same nucleic acid molecule. In an embodiment the nucleic acid encoding the CAR and the RNA encoding the telomerase subunit are part of separate nucleic acid molecules.

In an embodiment, the method comprises contacting the population of immune effector cells with a nucleic acid encoding the CAR and the RNA encoding the telomerase subunit at substantially the same time. In an embodiment, the method of making comprises contacting the population of immune effector cells with a nucleic acid encoding the CAR before contacting the population of immune effector cells with the RNA encoding the telomerase subunit. In an embodiment, the method comprises contacting the population of immune effector cells with a nucleic acid encoding the CAR after contacting the population of immune effector cells with the RNA encoding the telomerase subunit.

In an embodiment, the RNA encoding the telomerase subunit is mRNA. In an embodiment, the RNA encoding the telomerase subunit comprises a poly(A) tail. In an embodiment, the RNA encoding the telomerase subunit comprises a 5' cap structure.

In an embodiment, the method comprises transfecting the immune effector cells with the RNA encoding the telomerase subunit. In an embodiment, the method of making comprises transducing the immune effector cells with the RNA encoding the telomerase subunit. In an embodiment, the method of making comprises electroporating the immune effector cells with the RNA encoding the telomerase subunit, under conditions that allow for CAR and telomerase expression.

In embodiments, the method comprises providing a population of immune effector cells (e.g., T cells or NK cells) that express a CAR and/or comprise a nucleic acid encoding a CAR; and contacting the population of immune effector cells with a nucleic acid encoding a telomerase subunit, e.g., hTERT, under conditions that allow for hTERT expression.

In embodiments, the method comprises providing a population of immune effector cells (e.g., T cells or NK cells) that express a nucleic acid encoding a telomerase subunit, e.g., hTERT, and and contacting the population of immune effector cells with a nucleic acid encoding a CAR, under conditions that allow for CAR expression.

Immune Effector Cell Preparations

In some embodiments, an immune effector cell preparation (e.g., a reaction mixture, or a population of immune effector cells) described herein is made by a method described herein.

In embodiments, the immune effector cell preparation (e.g., reaction mixture) is chosen from:

(i) the population of immune effector cells comprises at least 20% naïve T cells, at least 2% stem central memory T cells, and/or at least 4% central memory T cells, and/or (ii) the population of immune effector cells comprises an absolute T cell count of at least 400 cells/microliter, an absolute naïve T cell count of at least 200 cells/microliter, an absolute stem central memory T cell count of at least 20 cells/microliter, and/or an absolute central memory T cell count of at least 40 cells/microliter.

In embodiments, the population of immune effector cells has been selected based upon the expression of one or more markers, e.g., CCR7, CD62L, CD45RO, and CD95, e.g., the population of immune effector cells (e.g., T cells) are CCR7+ and CD62L+.

In embodiments, the naïve T cells are identified based upon an expression pattern of CCR7+, CD62L+, CD45RO−, CD95−, wherein the stem central memory T cells are identified based upon an expression pattern of CCR7+, CD62L+, CD45RO−, CD95+, and wherein the central memory T cells are identified based upon an expression pattern of CCR7+, CD62L+, CD45RO+, CD95+.

In embodiments, an immune effector cell preparation described herein comprises a nucleic acid encoding a CAR, e.g., a CAR as described herein.

In embodiments, an immune effector cell preparation described herein comprises a nucleic acid encoding an exogenous telomerase subunit, e.g., hTERT. In an embodiment, the nucleic acid encoding an exogenous telomerase subunit is RNA, e.g., mRNA.

In embodiments, an immune effector cell preparation described herein comprises a CAR, e.g., a CAR as described herein; and an exogenous telomerase subunit, e.g., hTERT. In an embodiment, the cell does not comprise DNA encoding the exogenous telomerase subunit. For instance, the cell may have been contacted with mRNA encoding the exogenous telomerase subunit.

In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells. In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD25 expressing tumor cells, e.g., CLL cells. In one embodiment, the immune effector cell preparation contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the immune effector cell preparation contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of a checkpoint inhibitor expressing cells, e.g., a PD1+ cells, LAG3+ cells, or TIM3+ cells.

In one embodiment, the immune effector cell preparation is a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD14+ cells.

In embodiments, the immune effector cell preparation described herein comprises a population of autologous immune effector cells, e.g., a plurality of which are transfected or transduced with a vector comprising a nucleic acid molecule encoding a CAR, e.g., a CAR described herein, e.g., a CD19 CAR described herein, wherein the immune effector cell preparation contains less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of tumor cells, e.g., CLL cells. In one embodiment, the immune effector cell preparation contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the immune effector cell preparation contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In one embodiment, the reaction mixture can further comprise an agent that activates and/or expands to cells of the population, e.g., an agent that stimulates a CD3/TCR complex associated signal and/or a ligand that stimulates a costimulatory molecule on the surface of the cells, e.g., as described herein. In one embodiment, the agent is a bead conjugated with anti-CD3 antibody, or a fragment thereof, and/or anti-CD28 antibody, or a fragment thereof.

In embodiments, a reaction mixture described herein comprises a population of T regulatory-depleted cells containing less than 50%, 40%, 30%, 25%, 20%, 15%, 10%, 5%, 4%, 3%, 2%, 1% of CD25+ cells. In one embodiment, the reaction mixture comprises a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD25 expressing tumor cells, e.g., CLL cells. In one embodiment, the population of cells contains less than 15%, 10%, 5%, 4%, 3%, 2%, 1% of CD25+ cells and less than 15%, 10%, 5%, 4%, 3%, 2%, 1% of tumor cells, e.g., CD25 expressing tumor cells, e.g., CLL cells. In one embodiment, the population of cells contains less than 10%, 5%, 4%, 3%, 2%, 1% of CD25+ cells and less than 10%, 5%, 4%, 3%, 2%, 1% of tumor cells, e.g., CD25 expressing tumor cells, e.g., CLL cells.

In one embodiment, the reaction mixture comprises a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of a checkpoint inhibitor expressing cells, e.g., a PD1+ cells, LAG3+ cells, or TIM3+ cells. The reaction mixture may further comprise a buffer or other reagent, e.g., a PBS containing solution.

In one embodiment, the reaction mixture comprises a population of T regulatory-depleted cells containing less than 50%, 40%, 30%, 25%, 20%, 15%, 10%, 5%, 4%, 3%, 2%, 1% of CD25+ cells and less than 50%, 40%, 30%, 25%, 20%, 15%, 10%, 5%, 4%, 3%, 2%, 1% of CD14+ cells. The reaction mixture may further comprise a buffer or other reagent, e.g., a PBS containing solution.

In one embodiment, the reaction mixture further comprises one or more factor for proliferation and/or viability, including serum (e.g., fetal bovine or human serum), interleukin-2 (IL-2), insulin, IFN-γ, IL-4, IL-7, GM-CSF, IL-10, IL-12, IL-15, IL-21, TGFβ, and TNF-α or any other additives for the growth of cells. In one embodiment, the reaction mixture further comprises IL-15 and/or IL-7.

In one embodiment, a plurality of the cells of the population in the reaction mixture comprise a nucleic acid molecule, e.g., a nucleic acid molecule described herein, that comprises a CAR encoding sequence, e.g., a CD19 CAR encoding sequence, e.g., as described herein.

In one embodiment, a plurality of the cells of the population in the reaction mixture comprise a vector comprising a nucleic acid sequence encoding a CAR, e.g., a CAR described herein, e.g., a CD19 CAR described herein. In one embodiment, the vector is a vector described herein, e.g., a vector selected from the group consisting of a DNA, a RNA, a plasmid, a lentivirus vector, adenoviral vector, or a retrovirus vector.

In one embodiment, the reaction mixture further comprises a cryoprotectant or stabilizer such as, e.g., a saccharide, an oligosaccharide, a polysaccharide and a polyol (e.g., trehalose, mannitol, sorbitol, lactose, sucrose, glucose and dextran), salts and crown ethers. In one embodiment, the cryoprotectant is dextran.

In embodiments, the reaction mixture comprises a population of immune effector cells wherein a plurality of the cells of the population in the reaction mixture comprise a nucleic acid molecule, e.g., a nucleic acid molecule described herein, that comprises a CAR encoding sequence, e.g., a CD19 CAR encoding sequence, e.g., as described herein, and IL-7 and/or IL-15.

In one embodiment, a plurality of the cells of the population in the reaction mixture comprise a vector comprising a nucleic acid sequence encoding a CAR, e.g., a CAR described herein, e.g., a CD19 CAR described herein. In one embodiment, the vector is a vector described herein, e.g., a vector selected from the group consisting of a DNA, a RNA, a plasmid, a lentivirus vector, adenoviral vector, or a retrovirus vector.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

BRIEF DESCRIPTION OF THE FIGURES

FIG. 1A is a schematic diagram of C4-27z CAR vector. FIG. 1B is a graph showing the overall accumulation of CAR-T cells in response to various cytokines exposure. T cells were transduced and exposed to various exogenous cytokines with final concentrations of 10 ng/mL from the next day (day 0). The numbers of CAR-T cells were calculated based on the number of T cells and the percentages of CAR expression. The curves are representative of 6 donors. *P<0.05, ***P<0.001. NC, no cytokine. FIG. 1C is a histogram showing the proliferation of T cells in response to various cytokines. On day 7 after lentivirus transduction, T cells in NC group were labeled with CFSE (2.5 μM), and then exposed to various cytokines. Seven days later, T cells were analyzed for CFSE dilution by flow cytometry. FIG. 1D is a graph showing the viability of T cells 15 days after lentiviral transduction. T cells from various cytokine groups are stained with Annexin V and 7-AAD, and then analyzed for the proportions of viable cells (both Annexin V and 7-AAD negative). *P<0.05, **P<0.01 versus IL-2 group (n=6).

FIG. 2A shows CD95 expression in CD45RA+CD62L+ subpopulation of T cells before transduction and CAR-T cells 15 days after transduction. FIGS. 2B and 2C are graphs showing the increase of memory stem T cell (Tscm) proportions in CD4+ (FIG. 2B) and CD8+ T cells (FIG. 2C) after lentiviral transduction. Tscm are defined as CD45RA+CD62L+CD95+CCR7+ T cell subsets. FIG. 2D is a graph showing the correlation between the amount of naïve T (Tn, defined as CD45RA+CD62L+CD95− subpopulation) in T cells pre-transduction and the proportion of Tscm in CAR-T cells after transduction (n=6). Left bars represents the percentages of Tn in CD4+ and CD8+ T cells before transduction and right bars represents the percentages of Tscm in CD4+ and CD8+ CAR-T cells. *P<0.05, **P<0.01. FIG. 2E is a graph showing Self-renew and differentiation of different subsets of CAR-T cells. FACS-sorted CAR+ Tscm, Tcm, Tem and Temra cells are cultured exposed to IL-2 (10 ng/mL) for 3 days, then analyzed the phenotypes based on CD45RA and CD62L expression (n=3). FIG. 2F is a histogram plot showing the proliferation of various subsets of CAR-T cells in response to IL-2. FACS-sorted CAR+ Tscm, Tcm, Tem and Temra cells were labeled with CFSE (2.5 μM), and then cultured exposed to IL-2 (10 ng/mL) for 3 days. Three days later, T cells were analyzed for CFSE dilution.

FIG. 3A demonstrates that CD45RAexpression is inversely correlated with CFSE intensity. FIG. 3B shows that for all cytokine groups (IL-2, IL-7, IL-15, IL-18 and IL-21), CD45RA+ T cells exhibited much lower CFSE levels than CD45RA dim and negative T cells indicating that CD45RA+ T cells had stronger proliferation activity than CD45RA-T cells.

FIG. 4 is a series of graphs showing the quantitation of CD45RA, CD62L, CCR7, CD27, CD28 and IL7Rα expression by FACS on the surface of CAR-T cells in indicated cytokine groups. The histograms represent mean value±SEM of expression levels from 6 independent donors. *P<0.05, **P<0.01 versus IL-2 group.

FIGS. 5A, 5B, and 5C are quantitative plots showing the percentages of cytokine-producing CAR-T cells in various cytokine groups (n=6) for production of IFNγ (FIG. 5A), TNF-α (FIG. 5B) and IL-2 (FIG. 5C). Lentiviral transduced T cells are exposed to indicated cytokines for 14 days, and then co-cultured with SKOV3 cells for 5 hours before harvested for flow cytometry analysis. FIG. 5D is a graph showing the antigen specific cytotoxic activity of CAR-T cells. Fourteen days after indicated cytokine exposure, the CAR-T cells were assessed for cytolytic ability by using a luciferase-based assay after 18-hour coculture with SKOV3 at the indicated E/T ratios. Untransduced T cells (UNT) served as negative effector controls. Data shown are mean value±SEM of six independent cytolytic assays.

FIG. 6A-6C show the phenotype and function of the CAR-T cells described above in FIG. 5. FIGS. 6A and 6B show that CD62L+ CAR-T cells (Tscm and Tcm) exhibited less cytokine production activity (FIGS. 6A and 6B) and weaker cytolytic capacity (FIG. 6C) when compared with CD62L-CAR-T cells (Tem and Temra).

FIG. 7A depicts two graphs showing the overall accumulation and viability of CAR-T previously exposed to indicated cytokines upon antigen challenge. The T cells exposed to indicated cytokines are harvested on day 15, and then co-cultured with SKOV3 at E/T ratios of 5:1 for 7 days. The expansions of CAR-T cells are calculated and the viability of T cells are evaluated on the seventh day. FIG. 7B is two graphs showing the distribution of memory T subsets of CD4+ and CD8+ CAR-T cells in various cytokine groups. N.S., no statistical difference.

FIG. 8A shows tumor growth curves of mice treated with various cytokine exposed C4-27z CAR-T cells, anti-CD19-27z CAR-T cells and untransduced T cells. The data are presented as mean value±SEM. The arrow indicates the time of T cell infusion. FIG. 8B is a graph showing the quantitation of circulating human CD4+ and CD8+ T cell counts in mice peripheral blood 15 days after the first dose of CAR-T cell infusion. FIG. 8C is a graph showing the quantitation of CAR expression on circulating human CD4+ and CD8+ T cells in mice blood.

FIG. 10A is a graph showing the total cell number at the indicated days in culture. FIG. 10B is a graph showing the quantified population doublings at each indicated day in culture. FIG. 10C shows the percentage of viable cells at the indicated days in culture.

FIG. 25A is a bar graph showing the percent change in absolute memory phenotype cell count in patients with leukemia and lymphoma after culture with cytokines. Significant differences are denoted with an "*" above each column and represent P<0.05. FIG. 25B is a bar graph showing percent of samples passing test expansion evaluated after culture with or without cytokines. "All samples" represents every sample expanded without cytokines, some of which were collected before the split-culture protocol. Statistical analysis can be found in table 14.

DETAILED DESCRIPTION

Figure 1A:
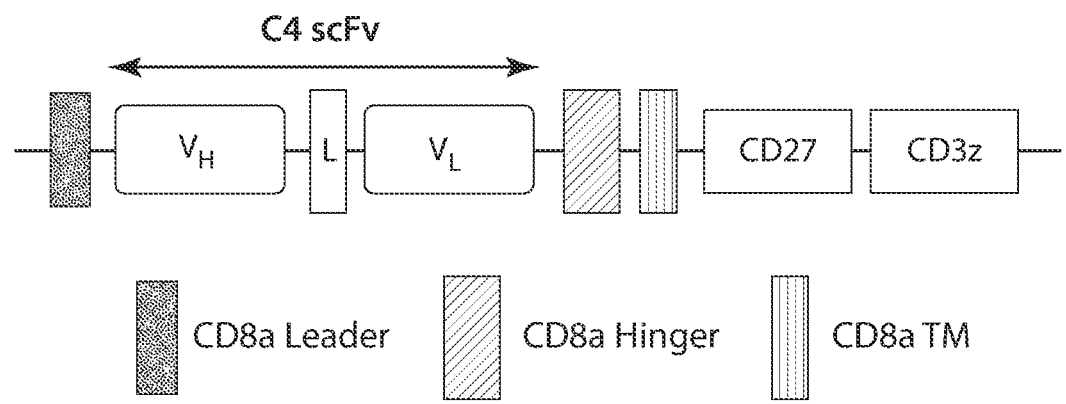
FIGS. 1A-1D show the differential effects of $\gamma_c$ cytokines and IL-18 on CAR-T cell accumulation.

The invention is based, at least in part, on the discovery that the fitness of immune effector cells (e.g., T cells or NK cells) for use in cellular therapy (e.g., a CAR therapy, e.g., as described herein) is correlated with a number of factors, including timing of chemotherapy relative to acquisition of cells from a subject, type of chemotherapy administered to a subject from which cells are acquired, underlying malignancy of a subject (from which cells are acquired), severity of the malignancy (e.g., standard-risk, high-risk, or very high-risk ALL), percentage of less differentiated T cells (e.g., naïve T cells, stem central memory T cells, or central memory T cells), percentage of terminal effector T cells, and number of T cells acquired from a subject (e.g., absolute T cell count).

As described in detail in the Examples, improved T cell expansion (e.g., which can indicate suitability for use in cellular therapy) was seen using cells acquired from a patient earlier during his/her chemotherapy (e.g., before administration of a chemotherapeutic cycle that depleted T cells with high proliferative capacity). Without wishing to be bound by theory, it is believed that acquiring cells from a patient early during his/her chemotherapy yields cell populations are less deteriorated, e.g., in their expansion capabilities. For example, improved T cell expansion was seen using cells acquired from patients prior to a delayed intensification cycle or consolidation cycle of chemotherapy. In embodiments, the severity of disease affects the deterioration of cells, e.g., cell expansion capability. In embodiments, cells acquired from patients having less severe disease (e.g., standard-risk ALL) expanded better than cells acquired from patients having more severe disease (e.g., high-risk or very high-risk ALL). In embodiments, patients with more severe disease (e.g., high-risk or very-high-risk ALL) may require cell acquisition earlier in chemotherapy (e.g., prior to cycle 2 or a consolidation cycle) compared to patients with less severe disease (e.g., standard-risk ALL). In embodiments, cells capable of expansion can be acquired from patients with less severe disease (e.g., standard-risk ALL) later in chemotherapy (e.g., prior to cycle 4 or a delayed intensification cycle) compared to patients with more severe disease. In other embodiments, cells acquired from patients with leukemia (e.g., ALL, e.g., pediatric ALL), had a better expansion capability than cells acquired from patients with lymphoma (e.g., NHL, e.g., pediatric NHL). Further, acquired cell populations that contained a higher absolute T cell count also tended to expand better than those with a lower absolute T cell count. Acquired cell populations that contained larger percentages of less differentiated immune effector cells (e.g., less differentiated T cells), which tend to have higher proliferative and survival capability, exhibited better expansion capability as well.

Without wishing to be bound by theory, it is believed that drugs used in some chemotherapeutic cycles, such as cyclophosphamide and cytarabine, significantly deplete highly proliferative T cells (e.g., less differentiated T cell), and this effect is more pronounced in patients with more severe disease. Longer duration of exposure or higher doses of chemotherapeutic drugs may lead to more depletion of these populations of T cells. Also, it is believed that a greater population of less differentiated T cells leads to greater T cell expansion capability, persistence, and efficacy as anti-cancer T cell therapy.

Accordingly, in embodiments, the methods advantageously improve T cell fitness (suitability for use in cellular therapy) and efficacy by acquiring cells from subjects early after diagnosis of a cancer, e.g., prior to chemotherapy or prior to certain/multiple chemotherapeutic cycles. In embodiments, the methods utilize cells acquired from patients prior to chemotherapeutic cycles containing T cell-depleting drugs, acquired prior to 2, 3, 4, or 5 cycles of chemotherapy, or acquired prior to delayed intensification or consolidation cycles. In other embodiments, the methods optimize expansion capability and/or anti-tumor efficacy of the immune cells by including patient selection, e.g., based on type of malignancy (e.g., leukemia versus lymphoma) or severity of disease (e.g., standard-, high-, or very high-risk). In yet other embodiments, the methods optimize expansion capability and/or anti-tumor efficacy of the immune cells by including cell selection, e.g., selection of cell populations having a higher absolute T cell count, or a higher percentage of less differentiated T cells. Further embodiments are described in greater detail herein.

Definitions

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

"Acquire" or "acquiring" as the terms are used herein, refer to obtaining possession of a physical entity (e.g., a sample, a cell or cell population, a polypeptide, a nucleic acid, or a sequence), or a value, e.g., a numerical value, by "directly acquiring" or "indirectly acquiring" the physical entity or value. In one embodiment, acquiring refers to obtaining or harvesting a cell or cell population (e.g., an immune effector cell or population as described herein). "Directly acquiring" means performing a process (e.g., performing a synthetic or analytical or purification method) to obtain the physical entity or value. "Indirectly acquiring" refers to receiving the physical entity or value from another party or source (e.g., a third party laboratory that directly acquired the physical entity or value). Directly acquiring a physical entity includes performing a process that includes a physical change in a physical substance, e.g., a starting material. Exemplary changes include making a physical entity from two or more starting materials, shearing or fragmenting a substance, separating or purifying a substance, combining two or more separate entities into a mixture, performing a chemical reaction that includes breaking or forming a covalent or non-covalent bond. Directly acquiring a value includes performing a process that includes a physical change in a sample or another substance, e.g., performing an analytical process which includes a physical change in a substance, e.g., a sample, analyte, or reagent (sometimes referred to herein as "physical analysis"), performing an analytical method, e.g., a method which includes one or more of the following: separating or purifying a substance, e.g., an analyte, or a fragment or other derivative thereof, from another substance; combining an analyte, or fragment or other derivative thereof, with another substance, e.g., a buffer, solvent, or reactant; or changing the structure of an analyte, or a fragment or other derivative thereof, e.g., by breaking or forming a covalent or non-covalent bond, between a first and a second atom of the analyte; or by changing the structure of a reagent, or a fragment or other derivative thereof, e.g., by breaking or forming a covalent or non-covalent bond, between a first and a second atom of the reagent.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some aspects, the set of polypeptides are contiguous with each other, e.g., are in the same polypeptide chain, e.g., comprise a chimeric fusion protein. In some embodiments, the set of polypeptides are not contiguous with each other, e.g., are in different polypeptide chains. In some embodiments, the set of polypeptides include a dimerization switch that, upon the presence of a dimerization molecule, can couple the polypeptides to one another, e.g., can couple an antigen binding domain to an intracellular signaling domain. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 4-1BB (i.e., CD137), CD27 and/or CD28. In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

A CAR that comprises an antigen binding domain (e.g., a scFv, or TCR) that targets a specific tumor antigen X, such as those described herein, is also referred to as XCAR. For example, a CAR that comprises an antigen binding domain that targets CD19 is referred to as CD19CAR.

The term "signaling domain" refers to the functional portion of a protein which acts by transmitting information within the cell to regulate cellular activity via defined signaling pathways by generating second messengers or functioning as effectors by responding to such messengers.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an antibody, that retains the ability to specifically interact with (e.g., by binding, steric hinderance, stabilizing/destabilizing, spatial distribution) an epitope of an antigen. Examples of antibody fragments include, but are not limited to, Fab, Fab', F(ab')$_2$, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide brudge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The portion of a CAR comprising an antibody or antibody fragment thereof may exist in a variety of forms where the antigen binding domain is expressed as part of a contiguous polypeptide chain including, for example, a single domain antibody fragment (sdAb), a single chain antibody (scFv) and a humanized antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one embodiment, the antigen binding domain of a CAR comprises an antibody fragment. In a further embodiment, the CAR comprises an antibody fragment that comprises a scFv. The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273,927-948 ("Chothia" numbering scheme), or a combination thereof.

As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The term "complementarity determining region" or "CDR," as used herein, refers to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273,927-948 ("Chothia" numbering scheme), or a combination thereof. Under the Kabat numbering scheme, in some embodiments, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under the Chothia numbering scheme, in some embodiments, the CDR amino acids in the VH are numbered 26-32 (HCDR1), 52-56 (HCDR2), and 95-102 (HCDR3); and the CDR amino acid residues in the VL are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a VH, e.g., a mammalian VH, e.g., a human VH; and amino acid residues 24-34 (LCDR1), 50-56 (LCDR2), and 89-97 (LCDR3) in a VL, e.g., a mammalian VL, e.g., a human VL.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody, or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically The term "xenogeneic" refers to any material derived from an animal of a different species.

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not conotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not conotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of a tumor antigen" as described herein includes, but is not limited to, a disease associated with expression of a tumor antigen as described herein or condition associated with cells which express a tumor antigen as described herein including, e.g., proliferative diseases such as a cancer or malignancy or a precancerous condition such as a myelodysplasia, a myelodysplastic syndrome or a preleukemia; or a noncancer related indication associated with cells which express a tumor antigen as described herein. In one embodiment, a cancer associated with expression of a tumor antigen as described herein is a hematological cancer. In one embodiment, a cancer associated with expression of a tumor antigen as described herein is a solid cancer. Further diseases associated with expression of a tumor antigen as described herein include, but not limited to, e.g., atypical and/or non-classical cancers, malignancies, precancerous conditions or proliferative diseases associated with expression of a tumor antigen as described herein. Non-cancer related indications associated with expression of a tumor antigen as described herein include, but are not limited to, e.g., autoimmune disease, (e.g., lupus), inflammatory disorders (allergy and asthma) and transplantation. In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein.

As used herein, the term "CD19" refers to the Cluster of Differentiation 19 protein, which is an antigenic determinant detectable on leukemia precursor cells. The human and murine amino acid and nucleic acid sequences can be found in a public database, such as GenBank, UniProt and Swiss-Prot. For example, the amino acid sequence of human CD19 can be found as UniProt/Swiss-Prot Accession No. P15391 and the nucleotide sequence encoding of the human CD19 can be found at Accession No. NM_001178098. As used herein, "CD19" includes proteins comprising mutations, e.g., point mutations, fragments, insertions, deletions and splice variants of full length wild-type CD19. CD19 is expressed on most B lineage cancers, including, e.g., acute lymphoblastic leukaemia, chronic lymphocyte leukaemia and non-Hodgkin lymphoma. Other cells with express CD19 are provided below in the definition of "disease associated with expression of CD19." It is also an early marker of B cell progenitors. See, e.g., Nicholson et al. Mol. Immun. 34 (16-17): 1157-1165 (1997). In one aspect the antigen-binding portion of the CART recognizes and binds an antigen within the extracellular domain of the CD19 protein. In one aspect, the CD19 protein is expressed on a cancer cell.

The phrase "disease associated with expression of CD19" includes, but is not limited to, a disease associated with expression of CD19 (e.g., wild-type or mutant CD19) or condition associated with cells which express, or at any time expressed, CD19 (e.g., wild-type or mutant CD19) including, e.g., proliferative diseases such as a cancer or malignancy or a precancerous condition such as a myelodysplasia, a myelodysplastic syndrome or a preleukemia; or a noncancer related indication associated with cells which express CD19. For the avoidance of doubt, a disease associated with expression of CD19 may include a condition associated with cells which do not presently express CD19, e.g., because CD19 expression has been downregulated, e.g., due to treatment with a molecule targeting CD19, e.g., a CD19 CAR, but which at one time expressed CD19. In one aspect, a cancer associated with expression of CD19 is a hematological cancer. In one aspect, the hematolical cancer is a leukemia or a lymphoma. In one aspect, a cancer associated with expression of CD19 includes cancers and malignancies including, but not limited to, e.g., one or more acute leukemias including but not limited to, e.g., B-cell acute Lymphoid Leukemia (BALL), T-cell acute Lymphoid Leukemia (TALL), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of CD19 comprise, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma (MCL), Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further diseases associated with expression of CD19 expression include, but not limited to, e.g., atypical and/or non-classical cancers, malignancies, precancerous conditions or proliferative diseases associated with expression of CD19. Non-cancer related indications associated with expression of CD19 include, but are not limited to, e.g., autoimmune disease, (e.g., lupus), inflammatory disorders (allergy and asthma) and transplantation. In some embodiments, the CD19-expressing cells express, or at any time expressed, CD19 mRNA. In an embodiment, the CD19-expressing cells produce a CD19 protein (e.g., wild-type or mutant), and the CD19 protein may be present at normal levels or reduced levels. In an embodiment, the CD19-expressing cells produced detectable levels of a CD19 protein at one point, and subsequently produced substantially no detectable CD19 protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR described herein can be replaced with other amino acid residues from the same side chain family and the altered CAR can be tested using the functional assays described herein.

The term "stimulation," refers to a primary response induced by binding of a stimulatory molecule (e.g., a TCR/CD3 complex or CAR) with its cognate ligand (or tumor antigen in the case of a CAR) thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:9, or the equivalent residues from a non-human species, e.g., mouse, rodent, monkey, ape and the like. In a specific CAR of the invention, the primary signaling sequence of CD3-zeta is the sequence as provided in SEQ ID NO:10, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. The intracellular signaling domain generates a signal that promotes an immune effector function of the CAR containing cell, e.g., a CART cell. Examples of immune effector function, e.g., in a CART cell, include cytolytic activity and helper activity, including the secretion of cytokines. In embodiments, the intracellular signaling domain is the portion of a protein which transduces the effector function signal and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, and CD66d, CD278 ("ICOS"), FcεRI, CD66d, CD32, DAP10 and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:9. In one aspect, the "zeta stimulatory domain" or a "CD3-zeta stimulatory domain" is the sequence provided as SEQ ID NO:10.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are contribute to an efficient immune response. Costimulatory molecules include, but are not limited to an MHC class I molecule, a TNF receptor protein, an Immunoglobulin-like protein, a cytokine receptor, an integrins, a signalling lymphocytic activation molecule (SLAM protein), an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. A costimulatory intracellular signaling domain refers to the intracellular portion of a costimulatory molecule. The intracellular signaling domain can comprise the entire intracellular portion, or the entire native intracellular signaling domain, of the molecule from which it is derived, or a functional fragment thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO:7 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. The term "nucleic acid" includes a gene, cDNA, or an mRNA. In one embodiment, the nucleic acid molecule is synthetic (e.g., chemically synthesized) or recombinant. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen" or "tumor antigen" interchangeably refers to a molecule (typically protein, carbohydrate or lipid) that is preferentially expressed on the surface of a cancer cell, either entirely or as a fragment (e.g., MHC/peptide), in comparison to a normal cell, and which is useful for the preferential targeting of a pharmacological agent to the cancer cell. In some embodiments, a cancer-associated antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a cancer-associated antigen is a cell surface molecule that is inappropriately synthesized in the cancer cell, for instance, a molecule that contains deletions, additions or mutations in comparison to the molecule expressed on a normal cell. In some embodiments, a cancer-associated antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21): 1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)$_n$ (SEQ ID NO: 22), where n is a positive integer equal to or greater than 1. For example, n=1, n=2, n=3. n=4, n=5 and n=6, n=7, n=8, n=9 and n=10. In one embodiment, the flexible polypeptide linkers include, but are not limited to, (Gly$_4$ Ser)$_4$ (SEQ ID NO:27) or (Gly$_4$ Ser)$_3$ (SEQ ID NO:28). In another embodiment, the linkers include multiple repeats of (Gly2Ser), (GlySer) or (Gly3Ser) (SEQ ID NO:29). In one embodiment, the linker is GSTSGSGKPGSGEGSTKG (SEQ ID NO: 104) Also included within the scope of the invention are linkers described in WO2012/138475, incorporated herein by reference).

As used herein, a 5' cap (also termed an RNA cap, an RNA 7-methylguanosine cap or an RNA m$^7$G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 30), preferably greater than 64, more preferably greater than 100, most preferably greater than 300 or 400 poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

Apheresis is the process in which whole blood is removed from an individual, separated into select components, and the remainder returned to circulation. Generally, there are two methods for the separation of blood components, centrifugal and non-centrifugal. Leukapheresis results in the active selection and removal of the patient's white blood cells.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"—refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count. Treatment need not be 100%, and in some embodiments a reduction or delay in at least one symptom of the disease or disorder by at least 50%, 60%, 70%, 80%, 90%, 95%, or 99% is sufficient to be considered within these terms.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become refractory during a treatment.

The term "relapse" as used herein refers to reappearance of a disease (e.g., cancer) after an initial period of responsiveness (e.g., complete response or partial response). The initial period of responsiveness may involve the level of cancer cells falling below a certain threshold, e.g., below 20%, 1%, 10%, 5%, 4%, 3%, 2%, or 1%. The reappearance may involve the level of cancer cells rising above a certain threshold, e.g., above 20%, 1%, 10%, 5%, 4%, 3%, 2%, or 1%. Relapse may be identified, e.g., using the Cheson criteria as described in Cheson et al, J Clin Oncol 17:1244 (1999) and Cheson et al., "Revised Response Criteria for Malignant Lymphoma", J Clin Oncol 25:579-586 (2007) (both of which are incorporated by reference herein in their entireties). For example, e.g., in the context of B-ALL, the reappearance may involve, e.g., a reappearance of blasts in the blood, bone marrow (>5%), or any extramedullary site, after a complete response. A complete response, in this context, may involve <5% BM blast. More generally, in an embodiment, a response (e.g., complete response or partial response) can involve the absence of detectable MRD (minimal residual disease). In an embodiment, the initial period of responsiveness lasts at least 1, 2, 3, 4, 5, or 6 days; at least 1, 2, 3, or 4 weeks; at least 1, 2, 3, 4, 6, 8, 10, or 12 months; or at least 1, 2, 3, 4, or 5 years.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, human).

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

In the context of the present invention, "tumor antigen" or "hyperproliferative disorder antigen" or "antigen associated with a hyperproliferative disorder" refers to antigens that are common to specific hyperproliferative disorders. In certain embodiments, the tumor antigen is derived from a cancer including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, or a ligand, which recognizes and binds with a cognate binding partner (e.g., a stimulatory and/or costimulatory molecule present on a T cell) protein present in a sample, but which antibody or ligand does not substantially recognize or bind other molecules in the sample.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

Therapeutic Methods

In one aspect, the disclosure provides methods for treating a disease associated with expression of a tumor antigen described herein.

In one aspect, the present disclosure provides methods of treating cancer (e.g., a hematological cancer such as ALL and CLL) by providing to the subject in need thereof immune effector cells (e.g., T cells, NK cells) that are engineered to express a CAR, e.g., a CAR described herein. In one embodiment, the cancer to be treated is a B cell malignancy. In one embodiment, the cancer to be treated is ALL (acute lymphoblastic leukemia), CLL (chronic lymphocytic leukemia), DLBCL (diffuse large B-cell lymphoma), MCL (Mantle cell lymphoma, or MM (multiple myeloma).

In one aspect, the disclosure provides methods of treating cancer (e.g., a hematological cancer such as ALL and CLL) by providing to the subject in need thereof immune effector cells (e.g., T cells, NK cells) that are engineered to express a CAR, e.g., a CAR as described herein, e.g., CD19 CAR, wherein the cancer cells express CD19. In one embodiment, the cancer to be treated is a B cell malignancy. In one embodiment, the cancer to be treated is ALL (acute lymphoblastic leukemia), CLL (chronic lymphocytic leukemia), DLBCL (diffuse large B-cell lymphoma), MCL (Mantle cell lymphoma), Hodgkin's lymphoma, or MM (multiple myeloma).

The disclosure includes a type of cellular therapy where immune effector cells (e.g., T cells, NK cells) are genetically modified (e.g., via transduction of a lentiviral vector) to express a CAR and the CAR-expressing cell is infused to a recipient in need thereof. The infused cell is able to kill tumor cells in the recipient. Unlike antibody therapies, CAR-modified immune effector cells (e.g., T cells, NK cells) are able to replicate in vivo resulting in long-term persistence that can lead to sustained tumor control. CAR-expressing cells (e.g., T cells or NK cells) generated using lentiviral vectors will have stable CAR expression. In various aspects, the immune effector cells (e.g., T cells, NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell to the patient.

The invention also includes a type of cellular therapy where immune effector cells (e.g., T cells, NK cells) are modified, e.g., by in vitro transcribed RNA, to transiently express a CAR and the CAR-expressing cell is infused to a recipient in need thereof. CAR-expressing cells (e.g., T cells, NK cells) generated through transduction of CAR RNA (e.g., by transfection or electroporation) transiently express RNA CARs for 4, 5, 6, 7, 8, 9, 10, 11, 12, 13, 14, 15 days after transduction. The infused cell is able to kill tumor cells in the recipient. Thus, in various aspects, the immune effector cells (e.g., T cells, NK cells) administered to the patient, is present for less than one month, e.g., three weeks, two weeks, one week, after administration of the T cell to the patient.

In one embodiment, the present disclosure provides methods of treating cancer (e.g., a hematological cancer such as ALL and CLL) by providing to the subject in need thereof immune effector cells (e.g., T cells, NK cells) that are engineered to express a CAR that specifically targets or binds to a tumor antigen (or cancer associated antigen) described herein. In yet another embodiment, the method of treatment includes altering the manufacturing of a CAR-expressing cell to enrich for naïve T cells, e.g., as described herein.

In one embodiment, the immune effector cells (e.g., T cells, NK cells) are engineered to express CD19 CAR, for treating a subject having cancer (e.g., a hematological cancer such as ALL and CLL), wherein the cancer cells express CD19. In one embodiment, the cancer to be treated is ALL or CLL. The CD19 CAR molecules to be expressed in an immune effector cell can comprise any anti-CD19 antigen binding domain in the art (e.g., those provided in Table 1 or 4) in combination with any of the CAR domains described herein to generate a full CAR construct. For example, the full CAR construct is a CAR listed in Table 4. Table 4 provides the exemplary full CD19 CAR constructs generated using the various CAR domains (e.g., transmembrane and intracellular signaling domains) described herein, and the anti-CD19 antigen binding domains listed in Table 1 or 4. Amino acid sequences are designated (aa) and nucleic acid sequences are designated (nt).

In one aspect, the disclosure provides methods for treating cancer, e.g., a cancer associated with CD19 expression, with a CAR-expressing cell (e.g., T cell, NK cell) therapy. Exemplary cancers include, but are not limited to e.g., one or more acute leukemias including but not limited to, e.g., B-ALL, T-ALL, ALL; one or more chronic leukemias including but not limited to, e.g., chronic myelogenous leukemia (CML), chronic lymphocytic leukemia (CLL).

Additional cancers or hematological conditions that can be treated with the methods described herein include, but are not limited to, e.g., B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like.

The aforesaid hematological conditions can be associated with expression of CD19. Further, a disease associated with CD19 expression include, but not limited to, e.g., atypical and/or non-classical cancers, malignancies, precancerous conditions or proliferative diseases associated with expression of CD19.

In one embodiment, the disclosure provides methods for treating CLL.

In another embodiment, the disclosure provides methods for treating ALL.

In another embodiment, the disclosure provides methods for treating B-cell ALL.

In one aspect, the disclosure provides methods of treating a subject having cancer (e.g., a hematological cancer such as ALL and CLL) with a CAR-expressing cell (e.g., T cell, NK cell) (e.g., a CD19 CAR-expressing cell (e.g., T cell, NK cell) as described herein, such as, e.g., CTL019). In an embodiment, the disclosure provides methods of treating a subject with a CAR-expressing cell (e.g., T cell, NK cell) in combination with another therapeutic agent, e.g., another therapeutic agent described herein (e.g., another CAR, e.g., another CAR described herein, an inhibitory CAR, e.g., an inhibitory CAR described herein; a chemotherapy; a kinase inhibitor (e.g., a kinase inhibitor described herein, e.g., an mTOR inhibitor, a BTK inhibitor), a checkpoint inhibitor, e.g., a checkpoint inhibitor described herein, a standard of care therapy, etc.). The combination can be, e.g., with any agent described herein.

In some embodiments, treatment of a cancer in a subject comprises administering a CAR therapy as described herein, in combination with one or more cycles of chemotherapy. In embodiments, exemplary cycles of chemotherapy include induction, consolidation, interim maintenance, delayed intensification, and maintenance.

In some embodiments, a first cycle of chemotherapy is induction, in which the goal is to eliminate as many cancerous cells as possible. In embodiments, in subjects suffering from leukemia (e.g., ALL), an induction cycle comprises treatment with one or more drugs, such as vincristine, dexamethasone, and/or polyethylene glycol (PEG)-L-asparaginase. In an embodiment, in subjects suffering from leukemia (e.g., ALL, e.g., standard-risk ALL), an induction cycle comprises treatment with vincristine, dexamethasone, and PEG-L-asparaginase, e.g., at doses of 6 mg/m$^2$, 6 mg/m$^2$, and 2500 U/m$^2$, respectively. In an embodiment, in subjects suffering from leukemia (e.g., ALL, e.g., high-risk ALL), an induction cycle comprises treatment with vincristine, dexamethasone, PEG-L-asparaginase, and daunorubicin, e.g., at doses of 6 mg/m$^2$, 6 mg/m$^2$, and 2500 U/m$^2$, and 100 mg/m$^2$, respectively.

In embodiments, a further cycle of chemotherapy is consolidation, in which the goal is to destroy any remaining cancerous cells. In some embodiments, consolidation cycle is given to a subject after remission is achieved after the induction cycle. In embodiments, in subjects suffering from leukemia (e.g., ALL), a consolidation cycle comprises treatment with one or more drugs, such as vincristine, 6-mercaptopurine, cyclophosphamide, cytarabine, and/or PEG-L-asparaginase. In an embodiment, in subjects suffering from leukemia (e.g., ALL, e.g., standard-risk ALL), a consolidation cycle comprises treatment with vincristine and 6-mercaptopurine, e.g., at doses of 1.5 mg/m$^2$ and 75 mg/m$^2$, respectively. In an embodiment, in subjects suffering from leukemia (e.g., ALL, e.g., high-risk ALL), a consolidation cycle comprises treatment with vincristine, 6-mercaptopurine, cyclophosphamide, cytarabine, and PEG-L-asparaginase, e.g., at doses of 1.5 mg/m$^2$, 60 mg/m$^2$, 1 g/m$^2$, 75 mg/m$^2$, and 2500 mg/m$^2$, respectively.

In embodiments, a further cycle of chemotherapy comprises a maintenance cycle, in which the goal is to reduce the long-term risk of cancer relapse, or interim maintenance cycle, in which the goal is to provide a break from intensive treatment. In embodiments, an interim maintenance cycle is performed after induction, and, in some cases, after consolidation. In embodiments, an interim maintenance cycle is performed before a delayed intensification cycle. In some embodiments, an interim maintenance cycle is performed after a delayed intensification cycle. In embodiments, a maintenance cycle is the last cycle of chemotherapy, e.g., after induction, consolidation, interim maintenance, and/or delayed intensification. In some embodiments, in subjects suffering from leukemia (e.g., ALL, e.g., standard-risk ALL), an interim maintenance cycle comprises treatment with vincristine and methotrexate, e.g., at doses of 7.5 mg/m$^2$ and 500 mg/m$^2$, respectively. In some embodiments, in subjects suffering from leukemia (e.g., ALL, e.g., high-risk ALL), an interim maintenance cycle comprises treatment with vincristine, methotrexate, and 6-mercaptopurine, e.g., at doses of 7.5 mg/m$^2$, 20 mg/m$^2$, and 25 mg/m$^2$, respectively. In embodiments, in subjects suffering from leukemia (e.g., ALL, e.g., standard-risk ALL), a maintenance cycle comprises treatment with vincristine, dexamethasone, 6-mercaptopurine, and methotrexate, e.g., at doses of 1.5 mg/m$^2$, 6 mg/m$^2$, 75 mg/m$^2$, and 20 mg/m$^2$, respectively. In embodiments, in subjects suffering from leukemia (e.g., ALL, e.g., high-risk ALL), a maintenance cycle comprises treatment with vincristine, prednisone, 6-mercaptopurine, and methotrexate, e.g., at doses of 1.5 mg/m$^2$, 40 mg/m$^2$, 75 mg/m$^2$, and 20 mg/m$^2$, respectively.

In embodiments, a further cycle of chemotherapy comprises a delayed intensification cycle, in which the goal is to eliminate any remaining cancerous cells. In embodiments, a delayed intensification cycle is performed after a consolidation cycle, and, e.g., after an interim maintenance cycle. In embodiments, in subjects suffering from leukemia (e.g., ALL, e.g., standard-risk ALL), a delayed intensification cycle comprises treatment with vincristine, dexamethasone, doxorubicin, PEG-L-asparginase, cyclophosphamide, cytarabine, and 6-thioguanine, e.g., at doses of 4.5 mg/m$^2$, 10 mg/m$^2$, 75 mg/m$^2$, 2500 U/m$^2$, 1 g/m$^2$, 60 mg/m$^2$, and 60 mg/m$^2$, respectively. In embodiments, in subjects suffering from leukemia (e.g., ALL, e.g., high-risk ALL), a delayed intensification cycle comprises treatment with vincristine, dexamethasone, doxorubicin, PEG-L-asparginase, cyclophosphamide, cytarabine, and 6-thioguanine, e.g., at doses of 7.5 mg/m$^2$, 10 mg/m$^2$, 75 mg/m$^2$, 5000 U/m$^2$, 1 g/m$^2$, 60 mg/m$^2$, and 60 mg/m$^2$, respectively.

In some embodiments, a subject is treated with varying intensities of chemotherapeutic regimens based on risk measurements, e.g., to maximize survival while minimizing toxicity. In embodiments, a subject, e.g., with ALL (e.g., pediatric ALL), is categorized into a standard risk or high-risk group, e.g., based on white blood cell counts and age, e.g., based on the National Cancer Institute (NCI) risk group classification. See, e.g., Smith et al. J. Clin. Oncol. 14.1 (1996):18-24. For example, a subject is categorized into a standard risk group if the white blood cell count is less than 50,000 cells per microliter and the subject is 1 to 10 years old. For example, a subject is categorized into a high risk group if the white blood cell count is 50,000 cells per microliter or greater and/or the subject is 10 years of age or older. In embodiments, a subject, e.g., with ALL (e.g., pediatric ALL), is categorized into a very high-risk group, as described in Moriche et al. Blood 111.9(2008):4477-89; and Pui et al. Blood 92.2(1998):411-5. For example, ALL subjects who have one or more of the following characteristics are classified as very high-risk ALL: a subject that is an infant; a subject with adverse cytogenetic abnormalities (e.g., t(9;22), MLL gene rearrangements, and low hypodiploidy (<44 chromosomes); a subject having a slow early response to initial therapy; a subject having a high minimal residual disease (MRD) level at the end of an induction cycle or in later cycles; a subject with morphologically persistent disease after an induction cycle.

In an embodiment, standard of care for CLL includes, but is not limited to exemplary therapies described herein, e.g., described in Table 5, and combinations thereof.

TABLE 5

Exemplary therapies for CLL

| | w/o del (11q) or del(17p) | del (17p) | del (11q) |
|---|---|---|---|
| First line ≥ 70 yrs with comorbidities | | | |
| Obinutuzumab + chlorambucil | X | X | X |
| Rituxan + chlorambucil | X | | X |
| Rituxan | X | | |
| Chlorambucil | X | | |
| Fludarabine ± Rituxan | X | X | |
| Cladribine | X | | |
| Bendamustine ± Rituxan | X | | X |
| PCR (pentostatin, cyclophosphamide, Rituxan) | X | | X |
| First line < 70 yrs without significant comorbidities | | | |
| FCR (Fludarabine, cyclophosphamide, Rituxan) | X | X | X |
| FR (Fludarabine, Rituxan) | X | X | |
| PCR | X | | X |
| Bendamustine ± Rituxan | X | | X |
| Obinutuzumab + chlorambucil | X | X | X |
| Second line-Relapsed/Refractory ≥ 70 years | | | |
| Imbruvica | X | X | X |
| Reduced-dose FCR | X | | X |
| Reduced-dose PCRR | X | | X |
| Bendamustine ± Rituxan | X | | X |
| Ofatumumab | X | X | X |
| Alemutuzumab + Rituxan | X | X | X |
| High dose methylprednisone (HDMP) + rituximab | X | X | X |
| Lenalidomide + Rituxan | X | X | X |
| Dose dense rituximab | X | | X |
| Second line-Relapsed/Refractory < years without significant comorbidities | | | |
| Imbruvica | X | X | X |
| FCR (Fludarabine, cyclophaside, Rituxan) | X | | X |
| PCR | X | | X |
| Bendamustine ± Rituxan | X | | X |

TABLE 5-continued

Exemplary therapies for CLL

| | w/o del (11q) or del(17p) | del (17p) | del (11q) |
|---|---|---|---|
| Fludarabine + alemtuzumab | X | | X |
| R-CHOP (Rituxan, cyclophosphamide, dosorubicin, vincristine, prednisone) | X | X | X |
| Ofatumumab | X | X | X |
| OFAR (oxaliplatin, Fludara, cytarabine, Rituxan) | X | X | X |
| HDMP + rituximab | X | X | X |
| Lenalidomide + Rituxan | X | X | X |

In an embodiment, standard of care for CLL includes (1) radiation therapy, (2) chemotherapy, (3) surgery (e.g., removal of the spleen), (4) targeted therapy, (5) stem cell transplantation, and combinations thereof. In an embodiment, the standard of care comprises external radiation therapy. In an embodiment, the standard of care comprises internal radiation therapy (e.g., a radioactive substance sealed in needles, wires or catheters, for example, that are placed directly into or near the cancer).

In an embodiment, standard of care for ALL includes, but is not limited to exemplary therapies described herein, e.g., described in Table 6, and combinations thereof.

TABLE 6

Exemplary therapies for ALL

First Line
RCHOP (Rituxan, cyclophosphamide, doxorubicin, vincristine, prednisone)
Dose dense RCHOP 14 (category 3)
Dose adjusted EPOCH (etoposide, prednisone, vincristine, cyclophosphamide, doxorubicin) + Rituxan
First Line Therapy for subjects with Poor left ventricular function or very frail
RCEPP (rituximab, cyclophosphamide, etoposide, prednisone, procarbazine)
RCEOP (rituximab, cyclophosphamide, etoposide, vincristine, prednisone)
RCNOP (rituximab, cyclophosphamide, mitoxantrone, vincristine, prednisone)
RCEOP (rituximab, cyclophosphamide, etoposide, vincristine, prednisone)
Dose adjusted EPOCH (etoposide, prednisone, vincristine, cyclophosphamide, doxorubicin) + Rituxan
Second line-proceed to high dose therapy with autologous stem cell rescue
DHAP (dexamethasone, cisplatin, cytarabine) ± Rituxan
ESHAP (etoposide, methylprednisolone, cytarabine, cisplatin) ± Rituxan
GDP (gemcitabine, dexamethasone, cisplatin) ± Rituxan
GemOX (gemcitabine, oxaliplatin) ± Rituxan
ICE (ifosfamide, carboplatin, etoposide) + Rituxan
MINE (mesna, ifosfamide, mitoxantrone, etoposide) ± Rituxan
Second line-therapy (non-candidates for high-dose therapy)
CEPP (cyclophosphamide, etoposide, prednisone, procarbazine) ± Rituxan
CEOP (cyclophosphamide, etoposide, vincristine, prednisone) ± Rituxan
DA-EPOCH ± Rituxan
Revlimid ± Rituxan
Rituxan
GemOX ± Rituxan
GDP ± Rituxan
Bendamustine + Rituxan In an embodiment, standard of care for ALL includes (1) chemotherapy, (2) radiation therapy, (3) stem cell transplantation, (4) biological therapy, (5) targeted therapy, and combinations thereof.

In an embodiment, the standard of care includes, but is not limited to, fludarabine with cyclophosphamide (FC); fludarabine with rituximab (FR); fludarabine, cyclophosphamide, and rituximab (FCR); cyclophosphamide, doxorubicin, vincristine and prednisone (CHOP); and combinations thereof. General chemotherapeutic agents considered for use include, but are not limited to anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), vinorelbine (Navelbine®), and combinations thereof.

In an embodiment, chemotherapy comprises an antimetabolite, including, but not limited to, folic acid antagonists (also referred to herein as antifolates), pyrimidine analogs, purine analogs and adenosine deaminase inhibitors): methotrexate (Rheumatrex®, Trexall®), 5-fluorouracil (Adrucil®, Efudex®, Fluoroplex®), floxuridine (FUDF®), cytarabine (Cytosar-U®, Tarabine PFS), 6-mercaptopurine (Puri-Nethol®)), 6-thioguanine (Thioguanine Tabloid®), fludarabine phosphate (Fludara®), pentostatin (Nipent®), pemetrexed (Alimta®), raltitrexed (Tomudex®), cladribine (Leustatin®), clofarabine (Clofarex®, Clolar®), cytarabine liposomal (also known as Liposomal Ara-C, DepoCyt™); decitabine (Dacogen®); hydroxyurea (Hydrea®, Droxia™ and Mylocel™); mercaptopurine (Puri-Nethol®), pralatrexate (Folotyn™); capecitabine (Xeloda®), nelarabine (Arranon®), azacitidine (Vidaza®) and gemcitabine (Gemzar®). Preferred antimetabolites include, e.g., 5-fluorouracil (Adrucil®, Efudex®, Fluoroplex®), floxuridine (FUDF®), capecitabine (Xeloda®), pemetrexed (Alimta®), raltitrexed (Tomudex®) and gemcitabine (Gemzar®), and combinations thereof. In an embodiment, the purine analogue is fludarabine.

In an embodiment, chemotherapy comprises an alkylating agent including, but not limited to nitrogen mustards, ethylenimine derivatives, alkyl sulfonates, nitrosoureas and triazenes, uracil mustard (Aminouracil Mustard®, Chlorethaminacil®, Demethyldopan®, Desmethyldopan®, Haemanthamine®, Nordopan®, Uracil nitrogen mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®) and combinations thereof. Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); Bendamustine HCl (Treanda®) and combinations thereof. In an embodiment, the alkylating agent is bendamustine. In an embodiment, the alkylating agent is cyclophosphamide.

In an embodiment, the chemotherapeutic agent is a kinase inhibitor, e.g., a tyrosine kinase inhibitor including, but not limited to, erlotinib hydrochloride (Tarceva®); linifanib (N-[4-(3-amino-1H-indazol-4-yl)phenyl]-N'-(2-fluoro-5-methylphenyl)urea, also known as ABT 869, available from Genentech); sunitinib malate (Sutent®); bosutinib (4-[(2,4-dichloro-5-methoxyphenyl)amino]-6-methoxy-7-[3-(4-methylpiperazin-1-yl)propoxy]quinoline-3-carbonitrile, also known as SKI-606, and described in U.S. Pat. No. 6,780,996); dasatinib (Sprycel®); pazopanib (Votrient®); sorafenib (Nexavar®); zactima (ZD6474); and imatinib or imatinib mesylate (Gilvec® and Gleevec®). In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662). In one embodiment, the kinase inhibitor is an MNK inhibitor selected from CGP052088; 4-amino-3-(p- fluorophenylamino)-pyrazolo[3,4-d]pyrimidine (CGP57-380); cercosporamide; ETC-1780445-2; and 4-amino-5-(4-fluoroanilino)-pyrazolo[3,4-d]pyrimidine.

In an embodiment, targeted therapy includes, but is not limited to an anti-CD20 antibody or functional fragment thereof, such as, e.g., rituximab (Riuxan® and MabThera®); tositumomab (Bexxar®); and ofatumumab (Arzerra®), and combinations thereof. In one embodiment, the targeted therapy includes, but is not limited to, an anti-CD52 antibody or functional fragment thereof such as, e.g., alemtuzumab (Campath®).

In an embodiment, biologic therapy comprises immunotherapy. Exemplary anthracyclines include, without limitation, doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; desacetylravidomycin and combinations thereof.

In an embodiment, stem cell transplantation comprises an autogeneic stem cell transplant. In an embodiment, stem cell transplantation comprises an allogenic stem cell transplant. In an embodiment, stem cell transplantation comprises allogeneic bone marrow transplantation. In an embodiment, stem cell transplantation comprises a hematopoietic stem cell transplantation (HSCT). In an embodiment, hematopoietic stem cells are derived from various tissues including, but not limited to bone marrow, peripheral blood, umbilical cord blood, and combinations thereof.

In one aspect, the disclosure provides methods for treating a disease associated with CD19 expression. In one aspect, the invention provides methods for treating a disease wherein part of the tumor is negative for CD19 and part of the tumor is positive for CD19. For example, provided methods are useful for treating subjects that have undergone treatment for a disease associated with elevated expression of CD19, wherein the subject that has undergone treatment for elevated levels of CD19 exhibits a disease associated with elevated levels of CD19.

In one aspect, provided methods comprise a vector comprising CD19 CAR operably linked to promoter for expression in mammalian cells (e.g., T cells or NK cells). In one aspect, provided methods comprise a recombinant cell (e.g., T cell or NK cell) expressing a CD19 CAR for use in treating CD19-expressing tumors, wherein the recombinant T cell expressing the CD19 CAR is termed a CD19 CAR-expressing cell. In one aspect, a CD19 CAR-expressing cell (e.g., T cell, NK cell) administered according to provided methods is capable of contacting a tumor cell with at least one CD19 CAR expressed on its surface such that the CAR-expressing cell targets the tumor cell and growth of the tumor is inhibited.

In one aspect, the disclosure features to a method of inhibiting growth of a CD19-expressing tumor cell, comprising contacting the tumor cell with a CD19 CAR-expressing cell (e.g., T cell, NK cell) described herein such that the CAR-expressing cell is activated in response to the antigen and targets the cancer cell, wherein the growth of the tumor is inhibited.

In one aspect, the disclosure includes a type of cellular therapy where T cells are genetically modified to express a CAR and the CAR-expressing cell (e.g., T cell, NK cell) is infused to a recipient in need thereof. The infused cell is able to kill tumor cells in the recipient. Unlike antibody therapies, CAR-modified cells (e.g., T cells or NK cells) are able to replicate in vivo resulting in long-term persistence that can lead to sustained tumor control. In various aspects, the cells administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the cell to the patient.

The disclosure also includes a type of cellular therapy where cells (e.g., T cells, NK cells) are modified, e.g., by in vitro transcribed RNA, to transiently express a chimeric antigen receptor (CAR) and the CAR-expressing cell (e.g., T cell, NK cell) is infused to a recipient in need thereof. The infused cell is able to kill tumor cells in the recipient. Thus, in various aspects, the cells administered to the patient, are present for less than one month, e.g., three weeks, two weeks, one week, after administration of the cell (e.g., T cell, NK cell) to the patient.

Without wishing to be bound by any particular theory, the anti-tumor immunity response elicited by the CAR-modified cells (e.g, T cells, NK cells) may be an active or a passive immune response, or alternatively may be due to a direct vs indirect immune response. In one aspect, the CAR transduced T cells exhibit specific proinflammatory cytokine secretion and potent cytolytic activity in response to human cancer cells expressing the CD19, resist soluble CD19 inhibition, mediate bystander killing and mediate regression of an established human tumor. For example, antigen-less tumor cells within a heterogeneous field of CD19-expressing tumor may be susceptible to indirect destruction by CD19-redirected T cells that has previously reacted against adjacent antigen-positive cancer cells.

In one aspect, the fully-human CAR-modified cells (e.g., T cells, NK cells) described herein may be a type of vaccine for ex vivo immunization and/or in vivo therapy in a mammal. In one aspect, the mammal is a human.

With respect to ex vivo immunization, at least one of the following occurs in vitro prior to administering the cell into a subject: i) expansion of the cells, ii) introducing a nucleic acid encoding a CAR to the cells or iii) cryopreservation of the cells.

Ex vivo procedures are known in the art and are discussed more fully below. Briefly, cells are isolated from a subject (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

Hematological Cancers

Hematological cancer conditions are types of cancer such as leukemia and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

The present disclosure provides for compositions and methods for treating cancer. In one aspect, the cancer is a hematologic cancer including but is not limited to a leukemia or a lymphoma. In one aspect, the CAR-expressing cells (e.g., T cells, NK cells) of the invention may be used to treat cancers and malignancies such as, but not limited to, e.g., acute leukemias including but not limited to, e.g., B-ALL, T-ALL, ALL; one or more chronic leukemias including but not limited to, e.g., CML, CLL; additional hematologic cancers or hematologic conditions including, but not limited to, e.g., B cell promyelocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma (MCL), marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like.

The present disclosure also provides methods for inhibiting the proliferation or reducing a CD19-expressing cell population, the methods comprising contacting a population of cells comprising a CD19-expressing cell with a CD19 CAR-expressing cell (e.g., T cell, NK cell) described herein that binds to the CD19-expressing cell. In a specific aspect, the disclosure provides methods for inhibiting the proliferation or reducing the population of cancer cells expressing CD19, the methods comprising contacting the CD19-expressing cancer cell population with a CD19 CAR-expressing cell (e.g., T cell, NK cell) described herein that binds to the CD19-expressing cell. In one aspect, the present disclosure provides methods for inhibiting the proliferation or reducing the population of cancer cells expressing CD19, the methods comprising contacting the CD19-expressing cancer cell population with a CD19 CAR-expressing cell (e.g., T cell, NK cell) described herein that binds to the CD19-expressing cell. In certain aspects, the anti-CD19 CAR-expressing cell (e.g., T cell, NK cell) reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with CD19-expressing cells relative to a negative control. In one aspect, the subject is a human.

The present disclosure also provides methods for preventing, treating and/or managing a disease associated with CD19-expressing cells (e.g., a hematologic cancer or atypical cancer expressing CD19), the methods comprising administering to a subject in need a CAR-expressing cell (e.g., T cell, NK cell) described herein that binds to the CD19-expressing cell. In one aspect, the subject is a human. Non-limiting examples of disorders associated with CD19-expressing cells include autoimmune disorders (such as lupus), inflammatory disorders (such as allergies and asthma) and cancers (such as hematological cancers or atypical cancers expressing CD19).

The present disclosure also provides methods for preventing, treating and/or managing a disease associated with CD19-expressing cells, the methods comprising administering to a subject in need a CD19 CAR-expressing cell (e.g., T cell, NK cell) described herein that binds to the CD19-expressing cell. In one aspect, the subject is a human.

The present disclosure provides methods for preventing relapse of cancer associated with CD19-expressing cells (e.g., a hematological cancer such as ALL and CLL), the methods comprising administering to a subject in need thereof a CD19 CAR-expressing cell (e.g., T cell, NK cell) described herein that binds to the CD19-expressing cell. In one aspect, the methods comprise administering to the subject in need thereof an effective amount of a CD19 CAR-expressing cell (e.g., T cell, NK cell) described herein that binds to the CD19-expressing cell in combination with an effective amount of another therapy.

Combination Therapy

It will be appreciated that any cancer therapy as described above and herein, can be administered in combination with one or more additional therapies to treat and/or reduce the symptoms of cancer described herein. The pharmaceutical compositions can be administered concurrently with, prior to, or subsequent to, one or more other additional therapies or therapeutic agents. In an embodiment, a CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

In further aspects, a CAR-expressing cell described herein may be used in a treatment regimen in combination with surgery, chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation peptide vaccine, such as that described in Izumoto et al. 2008 J NEUROSURG 108:963-971.

In one embodiment, a CAR-expressing cell described herein can be used in combination with a chemotherapeutic agent. Exemplary chemotherapeutic agents include an anthracycline (e.g., doxorubicin (e.g., liposomal doxorubicin)), a vinca alkaloid (e.g., vinblastine, vincristine, vindesine, vinorelbine), an alkylating agent (e.g., bendamustine, cyclophosphamide, decarbazine, melphalan, ifosfamide, temozolomide), an immune cell antibody (e.g., alemtuzamab, gemtuzumab, rituximab, tositumomab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide), and combinations thereof.

General Chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Exemplary alkylating agents include, without limitation, nitrogen mustards, ethylenimine derivatives, alkyl sulfonates, nitrosoureas and triazenes, uracil mustard (Aminouracil Mustard®, Chlorethaminacil®, Demethyldopan®, Desmethyldopan®, Haemanthamine®, Nordopan®, Uracil nitrogen mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®) and combinations thereof. Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); Bendamustine HCl (Treanda®) and combinations thereof.

Exemplary mTOR inhibitors include, without limitation, RAD001, temsirolimus; ridaforolimus (formally known as deferolimus, (1R,2R,4S)-4-[(2R)-2[(1R,9S,12S,15R,16E, 18R,19R,21R,23S,24E,26E,28Z,30S,32S,35R)-1,18-dihydroxy-19,30-dimethoxy-15,17,21,23,29,35-hexamethyl-2,3, 10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl] pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d] pyrimidin-7(8H)-one (PF04691502, CAS 1013101-36-4); and N$^2$[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-(SEQ ID NO: 356), inner salt (SF1126, CAS 936487-67-1), XL765 and combinations thereof.

Exemplary immunomodulators include, without limitation, afutuzumab (available from Roche®); pegfilgrastim (Neulasta®); lenalidomide (CC-5013, Revlimid®); thalidomide (Thalomid®), actimid (CC4047); IRX-2 (mixture of human cytokines including interleukin 1, interleukin 2, and interferon γ, CAS 951209-71-5, available from IRX Therapeutics) and combinations thereof.

Exemplary anthracyclines include, without limitation, doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; desacetylravidomycin and combinations thereof.

Exemplary vinca alkaloids include, without limitation, vinorelbine tartrate (Navelbine®), Vincristine (Oncovin®), Vindesine (Eldisine®)); vinblastine (also known as vinblastine sulfate, vincaleukoblastine and VLB, Alkaban-AQ® and Velban®); vinorelbine (Navelbine®) and combinations thereof.

Exemplary proteosome inhibitors include, without limitation, bortezomib (Velcade®); carfilzomib (PX-171-007, (S)-4-Methyl-N-((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912) and combinations thereof.

Exemplary GITR agonists include, without limitation, GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. No. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In an embodiment, a CAR expressing cell described herein, such as, e.g., a CD19 CAR-expressing cell (e.g., T cell, NK cell), e.g., CTL019 is administered to a subject, e.g., a subject identified as a partial responder or non-responder, in combination with an mTOR inhibitor, e.g., an mTOR inhibitor described herein, e.g., a target of the rapamycin signaling pathway such as RAD001. In an embodiment, the mTOR inhibitor is administered prior to the CAR-expressing cell. For example, in an embodiment, the mTOR inhibitor can be administered prior to apheresis of the cells. In an embodiment, the subject has cancer (e.g., a hematological cancer such as ALL and CLL). In an embodiment, the subject has ALL. In an embodiment, the subject has CLL.

In an embodiment, a CAR expressing cell described herein, such as, e.g., a CD19 CAR-expressing cell (e.g., T cell, NK cell), e.g., CTL019, is administered to a subject, e.g., a subject identified as a partial responder or non-responder, in combination with a GITR agonist, e.g., a GITR agonist described herein. In an embodiment, the GITR agonist is administered prior to the CAR-expressing cell. For example, in an embodiment, the GITR agonist can be administered prior to apheresis of the cells. In an embodiment, the subject has cancer (e.g., a hematological cancer such as ALL and CLL). In an embodiment, the subject has ALL. In an embodiment, the subject has CLL.

Kinase Inhibitor

In one embodiment, a CAR-expressing cell described herein may be used in a treatment regimen in combination with a kinase inhibitor, e.g., a CDK4 inhibitor, a BTK inhibitor, an MNK inhibitor, an mTOR inhibitor, an ITK inhibitor, etc. In one embodiment, the subject is a complete responder, and the subject is administered a treatment regimen that includes administration of a CAR-expressing cell described herein in combination with a kinase inhibitor, e.g., a kinase inhibitor described herein, e.g., at a dose or dosing schedule described herein. In one embodiment, the subject is a partial responder or a non-responder, and the subject is administered a treatment regimen that includes administration of a CAR-expressing cell described herein in combination with a kinase inhibitor, e.g., a kinase inhibitor described herein, e.g., at a dose or dosing schedule described herein.

In an embodiment, the kinase inhibitor is a CDK4 inhibitor, e.g., a CDK4 inhibitor described herein, e.g., a CDK4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor.

In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment, the kinase inhibitor is an mTOR inhibitor selected from temsirolimus; ridaforolimus (1R,2R, 4S)-4-[(2R)-2[(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.0$^{4,9}$]hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl)methanol (AZD8055); 2-mmino-8-[trans-4-(2-hydroxyethoxy)cyclohexyl]-6-(6-methoxy-3-pyridinyl)-4-methyl-pyrido[2,3-d]pyrimidin-7 (8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine- (SEQ ID NO: 356), inner salt (SF1126); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo[3,4-d]pyrimidine (CGP57380); cercosporamide; ETC-1780445-2; and 4-amino-5-(4-fluoroanilino)-pyrazolo[3,4-d]pyrimidine.

Combination with a Low Dose of an mTOR Inhibitor

Methods described herein can use a low, immune enhancing, dose of an mTOR inhibitor e.g., an allosteric mTOR inhibitor, including rapalogs such as RAD001. Administration of a low, immune enhancing, dose of an mTOR inhibitor (e.g., a dose that is insufficient to completely suppress the immune system, but sufficient to improve immune function) can optimize the performance of immune effector cells, e.g., T cells or CAR-expressing cells, in the subject. Methods for measuring mTOR inhibition, dosages, treatment regimens, and suitable pharmaceutical compositions are described in U.S. Patent Application No. 2015/0140036, filed Nov. 13, 2014, hereby incorporated by reference.

In an embodiment, administration of a low, immune enhancing, dose of an mTOR inhibitor can result in one or more of the following:
 i) a decrease in the number of PD-1 positive immune effector cells;
 ii) an increase in the number of PD-1 negative immune effector cells;
 iii) an increase in the ratio of PD-1 negative immune effector cells/PD-1 positive immune effector cells;
 iv) an increase in the number of naïve T cells;
 v) an increase in the expression of one or more of the following markers: CD62L$^{high}$ CD127$^{high}$, CD27$^+$, and BCL2, e.g., on memory T cells, e.g., memory T cell precursors;
 vi) a decrease in the expression of KLRG1, e.g., on memory T cells, e.g., memory T cell precursors; or
 vii) an increase in the number of memory T cell precursors, e.g., cells with any one or combination of the following characteristics: increased CD62L$^{high}$ increased CD127$^{high}$, increased CD27$^+$, decreased KLRG1, and increased BCL2;
and wherein any of the foregoing, e.g., i), ii), iii), iv), v), vi), or vii), occurs e.g., at least transiently, e.g., as compared to a non-treated subject.

In another embodiment, administration of a low, immune enhancing, dose of an mTOR inhibitor results in increased or prolonged proliferation of CAR-expressing cells, e.g., in culture or in a subject, e.g., as compared to non-treated CAR-expressing cells or a non-treated subject. In embodiments, increased proliferation is associated with in an increase in the number of CAR-expressing cells. In another embodiment, administration of a low, immune enhancing, dose of an mTOR inhibitor results in increased killing of cancer cells by CAR-expressing cells, e.g., in culture or in a subject, e.g., as compared to non-treated CAR-expressing cells or a non-treated subject. In embodiments, increased killing of cancer cells is associated with in a decrease in tumor volume.

In one embodiment, the cells expressing a CAR molecule, e.g., a CAR molecule described herein, are administered in combination with a low, immune enhancing dose of an mTOR inhibitor, e.g., an allosteric mTOR inhibitor, e.g., RAD001, or a catalytic mTOR inhibitor. For example, administration of the low, immune enhancing, dose of the mTOR inhibitor can be initiated prior to administration of a CAR-expressing cell described herein; completed prior to administration of a CAR-expressing cell described herein; initiated at the same time as administration of a CAR-expressing cell described herein; overlapping with administration of a CAR-expressing cell described herein; or continuing after administration of a CAR-expressing cell described herein.

Alternatively or in addition, administration of a low, immune enhancing, dose of an mTOR inhibitor can optimize immune effector cells to be engineered to express a CAR molecule described herein. In such embodiments, administration of a low, immune enhancing, dose of an mTOR inhibitor, e.g., an allosteric inhibitor, e.g., RAD001, or a catalytic inhibitor, is initiated or completed prior to harvest of immune effector cells, e.g., T cells or NK cells, to be engineered to express a CAR molecule described herein, from a subject.

In another embodiment, immune effector cells, e.g., T cells or NK cells, to be engineered to express a CAR molecule described herein, e.g., after harvest from a subject, or CAR-expressing immune effector cells, e.g., T cells or NK cells, e.g., prior to administration to a subject, can be cultured in the presence of a low, immune enhancing, dose of an mTOR inhibitor.

In an embodiment, administering to the subject a low, immune enhancing, dose of an mTOR inhibitor comprises administering, e.g., once per week, e.g., in an immediate release dosage form, 0.1 to 20, 0.5 to 10, 2.5 to 7.5, 3 to 6, or about 5, mgs of RAD001, or a bioequivalent dose thereof. In an embodiment, administering to the subject a low, immune enhancing, dose of an mTOR inhibitor comprises administering, e.g., once per week, e.g., in a sustained release dosage form, 0.3 to 60, 1.5 to 30, 7.5 to 22.5, 9 to 18, or about 15 mgs of RAD001, or a bioequivalent dose thereof.

In an embodiment, a dose of an mTOR inhibitor is associated with, or provides, mTOR inhibition of at least 5 but no more than 90%, at least 10 but no more than 90%, at least 15, but no more than 90%, at least 20 but no more than 90%, at least 30 but no more than 90%, at least 40 but no more than 90%, at least 50 but no more than 90%, at least 60 but no more than 90%, at least 70 but no more than 90%, at least 5 but no more than 80%, at least 10 but no more than 80%, at least 15, but no more than 80%, at least 20 but no more than 80%, at least 30 but no more than 80%, at least 40 but no more than 80%, at least 50 but no more than 80%, at least 60 but no more than 80%, at least 5 but no more than 70%, at least 10 but no more than 70%, at least 15, but no more than 70%, at least 20 but no more than 70%, at least 30 but no more than 70%, at least 40 but no more than 70%, at least 50 but no more than 70%, at least 5 but no more than 60%, at least 10 but no more than 60%, at least 15, but no more than 60%, at least 20 but no more than 60%, at least 30 but no more than 60%, at least 40 but no more than 60%, at least 5 but no more than 50%, at least 10 but no more than 50%, at least 15, but no more than 50%, at least 20 but no more than 50%, at least 30 but no more than 50%, at least 40 but no more than 50%, at least 5 but no more than 40%, at least 10 but no more than 40%, at least 15, but no more than 40%, at least 20 but no more than 40%, at least 30 but no more than 40%, at least 35 but no more than 40%, at least 5 but no more than 30%, at least 10 but no more than 30%, at least 15, but no more than 30%, at least 20 but no more than 30%, or at least 25 but no more than 30%.

The extent of mTOR inhibition can be conveyed as, or corresponds to, the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by various methods, such as measuring P70 S6 kinase activity by the Boulay assay, as described in U.S. Patent Application No. 2015/01240036, hereby incorporated by reference, or as described in U.S. Pat. No. 7,727,950, hereby incorporated by reference; measuring the level of phosphorylated S6 by western blot; or evaluating a change in the ratio of PD1 negative immune effector cells to PD1 positive immune effector cells.

As used herein, the term "mTOR inhibitor" refers to a compound or ligand, or a pharmaceutically acceptable salt thereof, which inhibits the mTOR kinase in a cell. In an embodiment, an mTOR inhibitor is an allosteric inhibitor. Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity. In an embodiment, an mTOR inhibitor is a catalytic inhibitor.

Rapamycin is a known macrolide antibiotic produced by Streptomyces hygroscopicus having the structure shown in Formula A.

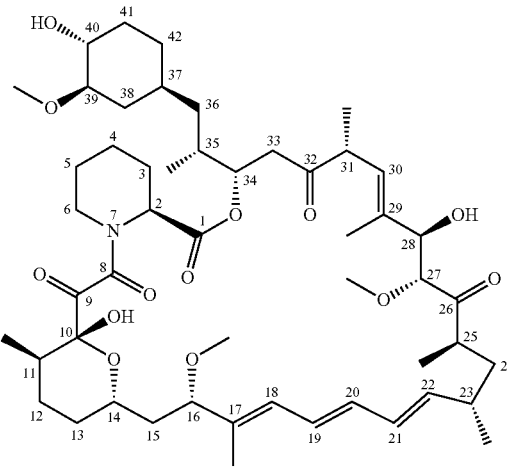

(A)

See, e.g., McAlpine, J. B., et al., J. Antibiotics (1991) 44: 688; Schreiber, S. L., et al., J. Am. Chem. Soc. (1991) 113: 7433; U.S. Pat. No. 3,929,992. There are various numbering schemes proposed for rapamycin. To avoid confusion, when specific rapamycin analogs are named herein, the names are given with reference to rapamycin using the numbering scheme of formula A.

Rapamycin analogs useful in the invention are, for example, O-substituted analogs in which the hydroxyl group on the cyclohexyl ring of rapamycin is replaced by $OR_1$ in which $R_1$ is hydroxyalkyl, hydroxyalkoxyalkyl, acylaminoalkyl, or aminoalkyl; e.g. RAD001, also known as, everolimus as described in U.S. Pat. No. 5,665,772 and WO94/09010 the contents of which are incorporated by reference. Other suitable rapamycin analogs include those substituted at the 26- or 28-position. The rapamycin analog may be an epimer of an analog mentioned above, particularly an epimer of an analog substituted in position 40, 28 or 26, and may optionally be further hydrogenated, e.g. as described in U.S. Pat. No. 6,015,815, WO95/14023 and WO99/15530 the contents of which are incorporated by reference, e.g. ABT578 also known as zotarolimus or a rapamycin analog described in U.S. Pat. No. 7,091,213, WO98/02441 and WO01/14387 the contents of which are incorporated by reference, e.g. AP23573 also known as ridaforolimus.

Examples of rapamycin analogs suitable for use in the present invention from U.S. Pat. No. 5,665,772 include, but are not limited to, 40-O-benzyl-rapamycin, 40-O-(4'-hydroxymethyl)benzyl-rapamycin, 40-O-[4'-(1,2-dihydroxyethyl)]benzyl-rapamycin, 40-O-allyl-rapamycin, 40-O-[3'-(2,2-dimethyl-1,3-dioxolan-4(S)-yl)-prop-2'-en-1'-yl]-rapamycin, (2'E,4'S)-40-O-(4',5'-dihydroxypent-2'-en-1'-yl)-rapamycin, 40-O-(2-hydroxy)ethoxycarbonylmethyl-rapamycin, 40-O-(2-hydroxy)ethyl-rapamycin, 40-O-(3-hydroxy)propyl-rapamycin, 40-O-(6-hydroxy)hexyl-rapamycin, 40-O-[2-(2-hydroxy)ethoxy]ethyl-rapamycin, 40-O-[(3S)-2,2-dimethyldioxolan-3-yl]methyl-rapamycin, 40-O-[(2S)-2,3-dihydroxyprop-1-yl]-rapamycin, 40-O-(2-acetoxy)ethyl-rapamycin, 40-O-(2-nicotinoyloxy)ethyl-rapamycin, 40-O-[2-(N-morpholino)acetoxy]ethyl-rapamycin, 40-O-(2-N-imidazolylacetoxy)ethyl-rapamycin, 40-O-[2-(N-methyl-N'-piperazinyl)acetoxy]ethyl-rapamycin, 39-O-desmethyl-39,40-O,O-ethylene-rapamycin, (26R)-26-dihydro-40-O-(2-hydroxy)ethyl-rapamycin, 40-O-(2-aminoethyl)-rapamycin, 40-O-(2-acetaminoethyl)-rapamycin, 40-O-(2-nicotinamidoethyl)-rapamycin, 40-O-(2-(N-methyl-imidazo-2'-ylcarbethoxamido)ethyl)-rapamycin, 40-O-(2-ethoxycarbonylaminoethyl)-rapamycin, 40-O-(2-tolylsulfonamidoethyl)-rapamycin and 40-O-[2-(4',5'-dicarboethoxy-1',2',3'-triazol-1'-yl)-ethyl]-rapamycin.

Other rapamycin analogs useful in the present invention are analogs where the hydroxyl group on the cyclohexyl ring of rapamycin and/or the hydroxy group at the 28 position is replaced with an hydroxyester group are known, for example, rapamycin analogs found in U.S. RE44,768, e.g. temsirolimus.

Other rapamycin analogs useful in the preset invention include those wherein the methoxy group at the 16 position is replaced with another substituent, preferably (optionally hydroxy-substituted) alkynyloxy, benzyl, orthomethoxybenzyl or chlorobenzyl and/or wherein the mexthoxy group at the 39 position is deleted together with the 39 carbon so that the cyclohexyl ring of rapamycin becomes a cyclopentyl ring lacking the 39 position methyoxy group; e.g. as described in WO95/16691 and WO96/41807 the contents of which are incorporated by reference. The analogs can be further modified such that the hydroxy at the 40-position of rapamycin is alkylated and/or the 32-carbonyl is reduced.

Rapamycin analogs from WO95/16691 include, but are not limited to, 16-demthoxy-16-(pent-2-ynyl)oxy-rapamycin, 16-demthoxy-16-(but-2-ynyl)oxy-rapamycin, 16-demthoxy-16-(propargyl)oxy-rapamycin, 16-demethoxy-16-(4-hydroxy-but-2-ynyl)oxy-rapamycin, 16-demthoxy-16-benzyloxy-40-O-(2-hydroxyethyl)-rapamycin, 16-demthoxy-16-benzyloxy-rapamycin, 16-demethoxy-16-orthomethoxybenzyl-rapamycin, 16-demethoxy-40-O-(2-methoxyethyl)-16-pent-2-ynyl)oxy-rapamycin, 39-demethoxy-40-desoxy-39-formyl-42-nor-rapamycin, 39-demethoxy-40-desoxy-39-hydroxymethyl-42-nor-rapamycin, 39-demethoxy-40-desoxy-39-carboxy-42-nor-rapamycin, 39-demethoxy-40-desoxy-39-(4-methyl-piperazin-1-yl)carbonyl-42-nor-rapamycin, 39-demethoxy-40-desoxy-39-(morpholin-4-yl)carbonyl-42-nor-rapamycin, 39-demethoxy-40-desoxy-39-[N-methyl, N-(2-pyridin-2-yl-ethyl)]carbamoyl-42-nor-rapamycin and 39-demethoxy-40-desoxy-39-(p-toluenesulfonylhydrazonomethyl)-42-nor-rapamycin.

Rapamycin analogs from WO96/41807 include, but are not limited to, 32-deoxo-rapamycin, 16-O-pent-2-ynyl-32-deoxo-rapamycin, 16-O-pent-2-ynyl-32-deoxo-40-O-(2-hydroxy-ethyl)-rapamycin, 16-O-pent-2-ynyl-32-(S)-dihydro-40-O-(2-hydroxyethyl)-rapamycin, 32(S)-dihydro-40-O-(2-methoxy)ethyl-rapamycin and 32(S)-dihydro-40-O-(2-hydroxyethyl)-rapamycin.

Another suitable rapamycin analog is umirolimus as described in US2005/0101624 the contents of which are incorporated by reference.

RAD001, otherwise known as everolimus (Afinitor®), has the chemical name (1R,9S,12S,15R,16E,18R,19R,21R,23S,24E,26E,28E,30S,32S,35R)-1,18-dihydroxy-12-{(1R)-2-[1S,3R,4R)-4-(2-hydroxyethoxy)-3-methoxycyclohexyl]-1-methylethyl}-19,30-dimethoxy-15,17,21,23,29,35-hexamethyl-11,36-dioxa-4-aza-tricyclo[30.3.1.04,9]hexatriaconta-16,24,26,28-tetraene-2,3,10,14,20-pentaone Further examples of allosteric mTOR inhibitors include sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669). Other examples of allosteric mTor inhibtors include zotarolimus (ABT578) and umirolimus.

Alternatively or additionally, catalytic, ATP-competitive mTOR inhibitors have been found to target the mTOR kinase domain directly and target both mTORC1 and mTORC2. These are also more effective inhibitors of mTORC1 than such allosteric mTOR inhibitors as rapamycin, because they modulate rapamycin-resistant mTORC1 outputs such as 4EBP1-T37/46 phosphorylation and cap-dependent translation.

Catalytic inhibitors include: BEZ235 or 2-methyl-2-[4-(3-methyl-2-oxo-8-quinolin-3-yl-2,3-dihydro-imidazo[4,5-c]-quinolin-1-yl)-phenyl]-propionitrile, or the monotosylate salt form. the synthesis of BEZ235 is described in WO2006/122806; CCG168 (otherwise known as AZD-8055, Chresta, C. M., et al., Cancer Res, 2010, 70(1), 288-298) which has the chemical name {5-[2,4-bis-((S)-3-methyl-morpholin-4-yl)-pyrido[2,3d]pyrimidin-7-yl]-2-methoxy-phenyl}-methanol; 3-[2,4-bis[(3S)-3-methylmorpholin-4-yl]pyrido[2,3-d]pyrimidin-7-yl]-N-methylbenzamide (WO09104019); 3-(2-aminobenzo[d]oxazol-5-yl)-1-isopropyl-1H-pyrazolo[3,4-d]pyrimidin-4-amine (WO10051043 and WO2013023184); A N-(3-(N-(3-((3,5-dimethoxyphenyl)amino)quinoxaline-2-yl)sulfamoyl)phenyl)-3-methoxy-4-methylbenzamide (WO07044729 and WO12006552); PKI-587 (Venkatesan, A. M., J. Med. Chem., 2010, 53, 2636-2645) which has the chemical name 1-[4-[4-(dimethylamino)piperidine-1-carbonyl]phenyl]-3-[4-(4,6-dimorpholino-1,3,5-triazin-2-yl)phenyl]urea; GSK-2126458 (ACS Med. Chem. Lett., 2010, 1, 39-43) which has the chemical name 2,4-difluoro-N-{2-methoxy-5-[4-(4-pyridazinyl)-6-quinolinyl]-3-pyridinyl} benzenesulfonamide; 5-(9-isopropyl-8-methyl-2-morpholino-9H-purin-6-yl)pyrimidin-2-amine (WO10114484); (E)-N-(8-(6-amino-5-(trifluoromethyl)pyridin-3-yl)-1-(6-(2-cyanopropan-2-yl)pyridin-3-yl)-3-methyl-1H-imidazo[4,5-c]quinolin-2(3H)-ylidene)cyanamide (WO12007926).

Further examples of catalytic mTOR inhibitors include 8-(6-methoxy-pyridin-3-yl)-3-methyl-1-(4-piperazin-1-yl-3-trifluoromethyl-phenyl)-1,3-dihydro-imidazo[4,5-c]quinolin-2-one (WO2006/122806) and Ku-0063794 (Garcia-Martinez J M, et al., Biochem J., 2009, 421(1), 29-42. Ku-0063794 is a specific inhibitor of the mammalian target of rapamycin (mTOR).) WYE-354 is another example of a catalytic mTor inhibitor (Yu K, et al. (2009). Biochemical, Cellular, and In vivo Activity of Novel ATP-Competitive and Selective Inhibitors of the Mammalian Target of Rapamycin. Cancer Res. 69(15): 6232-6240).

mTOR inhibitors useful according to the present invention also include prodrugs, derivatives, pharmaceutically acceptable salts, or analogs thereof of any of the foregoing.

mTOR inhibitors, such as RAD001, may be formulated for delivery based on well-established methods in the art based on the particular dosages described herein. In particular, U.S. Pat. No. 6,004,973 (incorporated herein by reference) provides examples of formulations useable with the mTOR inhibitors described herein.

Further combination therapies may include anti-allergenic agents, anti-emetics, analgesics, adjunct therapies.

Some patients may experience allergic reactions to the therapeutics described herein and/or other anti-cancer agent(s) during or after administration; therefore, anti-allergic agents are often administered to minimize the risk of an allergic reaction. Suitable anti-allergic agents include corticosteroids, such as dexamethasone (e.g., Decadron®), beclomethasone (e.g., Beclovent®), hydrocortisone (also known as cortisone, hydrocortisone sodium succinate, hydrocortisone sodium phosphate, and sold under the tradenames Ala-Cort®, hydrocortisone phosphate, Solu-Cortel®, Hydrocort Acetate® and Lanacort®), prednisolone (sold under the tradenames Delta-Cortel®, Orapred®, Pediapred® and Prelone®), prednisone (sold under the tradenames Deltasone®, Liquid Red®, Meticorten® and Orasone®), methylprednisolone (also known as 6-methylprednisolone, methylprednisolone acetate, methylprednisolone sodium succinate, sold under the tradenames Duralone®, Medralone®, Medrol®, M-Prednisol® and Solu-Medrol®); antihistamines, such as diphenhydramine (e.g., Benadryl®), hydroxyzine, and cyproheptadine; and bronchodilators, such as the beta-adrenergic receptor agonists, albuterol (e.g., Proventil®), and terbutaline (Brethine®).

Some patients may experience nausea during and after administration of the therapeutics described herein and/or other anti-cancer agent(s); therefore, anti-emetics are used in preventing nausea (upper stomach) and vomiting. Suitable anti-emetics include aprepitant (Emend®), ondansetron (Zofran®), granisetron HCl (Kytril®), lorazepam (Ativan®), dexamethasone (Decadron®), prochlorperazine (Compazine®), casopitant (Rezonic® and Zunrisa®), and combinations thereof.

Medication to alleviate the pain experienced during the treatment period is often prescribed to make the patient more comfortable. Common over-the-counter analgesics, such Tylenol®, are often used. However, opioid analgesic drugs such as hydrocodone/paracetamol or hydrocodone/acetaminophen (e.g., Vicodin®), morphine (e.g., Astramorph® or Avinza®), oxycodone (e.g., OxyContin® or Percocet®), oxymorphone hydrochloride (Opana®), and fentanyl (e.g., Duragesic®) are also useful for moderate or severe pain.

In an effort to protect normal cells from treatment toxicity and to limit organ toxicities, cytoprotective agents (such as neuroprotectants, free-radical scavengers, cardioprotectors, anthracycline extravasation neutralizers, nutrients and the like) may be used as an adjunct therapy. Suitable cytoprotective agents include Amifostine (Ethyol®), glutamine, dimesna (Tavocept®), mesna (Mesnex®), dexrazoxane (Zinecard® or Totect®), xaliproden (Xaprila®), and leucovorin (also known as calcium leucovorin, citrovorum factor and folinic acid).

The structure of the active compounds identified by code numbers, generic or trade names may be taken from the actual edition of the standard compendium "The Merck Index" or from databases, e.g. Patents International (e.g. IMS World Publications).

The above-mentioned compounds, which can be used in combination with a compound of the present invention, can be prepared and administered as described in the art, such as in the documents cited above.

In one embodiment, the present invention provides pharmaceutical compositions comprising at least one compound of the present invention (e.g., a compound of the present invention) or a pharmaceutically acceptable salt thereof together with a pharmaceutically acceptable carrier suitable for administration to a human or animal subject, either alone or together with other anti-cancer agents.

In one embodiment, the present invention provides methods of treating human or animal subjects suffering from a cellular proliferative disease, such as cancer. The present invention provides methods of treating a human or animal subject in need of such treatment, comprising administering to the subject a therapeutically effective amount of a compound of the present invention (e.g., a compound of the present invention) or a pharmaceutically acceptable salt thereof, either alone or in combination with other anti-cancer agents.

In particular, compositions will either be formulated together as a combination therapeutic or administered separately.

In combination therapy, the compound of the present invention and other anti-cancer agent(s) may be administered either simultaneously, concurrently or sequentially with no specific time limits, wherein such administration provides therapeutically effective levels of the two compounds in the body of the patient.

In a preferred embodiment, the compound of the present invention and the other anti-cancer agent(s) is generally administered sequentially in any order by infusion or orally. The dosing regimen may vary depending upon the stage of the disease, physical fitness of the patient, safety profiles of the individual drugs, and tolerance of the individual drugs, as well as other criteria well-known to the attending physician and medical practitioner(s) administering the combination. The compound of the present invention and other anti-cancer agent(s) may be administered within minutes of each other, hours, days, or even weeks apart depending upon the particular cycle being used for treatment. In addition, the cycle could include administration of one drug more often than the other during the treatment cycle and at different doses per administration of the drug.

In another aspect of the present invention, kits that include one or more compound of the present invention and a combination partner as disclosed herein are provided. Representative kits include (a) a compound of the present invention or a pharmaceutically acceptable salt thereof, (b) at least one combination partner, e.g., as indicated above, whereby such kit may comprise a package insert or other labeling including directions for administration.

A compound of the present invention may also be used to advantage in combination with known therapeutic processes, for example, the administration of hormones or especially radiation. A compound of the present invention may in particular be used as a radiosensitizer, especially for the treatment of tumors which exhibit poor sensitivity to radiotherapy.

Manufacturing and Methods of Making Immune Effector Cells

Provided herein are methods of manufacturing immune effector cells (e.g., T cells, NK cells) that can be engineered with a CAR, e.g., a CAR described herein, and reaction mixtures and compositions comprising such cells.

In one aspect, the disclosure features an immune effector cell (e.g., T cell, NK cell) engineered to express a CAR, wherein the engineered immune effector cell exhibits an antitumor property. A preferred antigen is a cancer associated antigen (i.e., tumor antigen) described herein. In one aspect, a cell is transformed with the CAR and the CAR is expressed on the cell surface. In some embodiments, the cell (e.g., T cell, NK cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., T cell, NK cell) is transfected with a nucleic acid, e.g., mRNA, cDNA, DNA, encoding a CAR. In some such embodiments, the cell may transiently express the CAR.

Furthermore, the present invention provides CART compositions and their use in medicaments or methods for treating, among other diseases, cancer or any malignancy or autoimmune diseases involving cells or tissues which express a tumor antigen as described herein.

In one aspect, the CAR of the invention can be used to eradicate a normal cell that express a tumor antigen as described herein, thereby applicable for use as a cellular conditioning therapy prior to cell transplantation.

Sources of Immune Effector Cells

In embodiments, prior to expansion and genetic modification or other modification, a source of cells, e.g., T cells or natural killer (NK) cells, e.g., a population of T cells or NK cells, can be acquired, e.g., obtained, from a subject. The term "subject" is intended to include living organisms in which an immune response can be elicited (e.g., mammals). Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In some embodiments, a cell population, e.g., a harvested cell population, comprises a T cell or population of T cells, e.g., at various stages of differentiation. Stages of T cell differentiation include naïve T cells, stem central memory T cells, central memory T cells, effector memory T cells, and terminal effector T cells, from least to most differentiated. After antigen exposure, naïve T cells proliferate and differentiate into memory T cells, e.g., stem central memory T cells and central memory T cells, which then differentiate into effector memory T cells. Upon receiving appropriate T cell receptor, costimulatory, and inflammatory signals, memory T cells further differentiate into terminal effector T cells. See, e.g., Restifo. Blood. 124.4(2014):476-77; and Joshi et al. J. Immunol. 180.3(2008):1309-15.

Naïve T cells ($T_N$) are characterized by the following expression pattern of cell surface markers: CCR7+, CD62L+, CD45RO−, CD95−. Stem central memory T cells ($T_{SCM}$) are characterized by the following expression pattern of cell surface markers: CCR7+, CD62L+, CD45RO−, CD95+. Central memory T cells ($T_{CM}$) are characterized by the following expression pattern of cell surface markers: CCR7+, CD62L+, CD45RO+, CD95+. Effector memory T cells ($T_{EM}$) are characterized by the following expression pattern of cell surface markers: CCR7−, CD62L−, CD45RO+, CD95+. Terminal effector T cells ($T_{Eff}$) are characterized by the following expression pattern of cell surface markers: CCR7−, CD62L−, CD45RO−, CD95+. See, e.g., Gattinoni et al. Nat. Med. 17(2011):1290-7; and Flynn et al. Clin. Translat. Immunol. 3(2014):e20.

In certain aspects of the present disclosure, immune effector cells, e.g., T cells, can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" Clinical & Translational Immunology (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory-depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, e.g. IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depleting reagent from Miltenyi™. In one embodiment, the ratio of cells to CD25 depletion reagent is 1e7 cells to 20 uL, or 1e7 cells to15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory-depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product significantly reduces the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

In an embodiment, the CAR-expressing cell (e.g., T cell, NK cell) manufacturing process is modified to deplete $T_{REG}$ cells prior to manufacturing of the CAR-expressing cell (e.g., T cell, NK cell) product (e.g., a CTL019 product). In an embodiment, CD25-depletion is used to deplete $T_{REG}$ cells prior to manufacturing of the CAR-expressing cell (e.g., T cell, NK cell) product (e.g., a CTL019 product).

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory-depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory-depleted, e.g., CD25+ depleted cells, and check point inhibitor depleted cells, e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR (e.g., TGFRbeta), e.g., as described herein. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

Methods described herein can include a positive selection step. For example, T cells can isolated by incubation with anti-CD3/anti-CD28 (e.g., 3×28)-conjugated beads, such as DYNABEADS® M-450 CD3/CD28 T, for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another embodiment, the time period is 10 to 24 hours, e.g., 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 10 billion cells/ml, 9 billion/ml, 8 billion/ml, 7 billion/ml, 6 billion/ml, or 5 billion/ml is used. In one aspect, a concentration of 1 billion cells/ml is used. In yet one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5\times10^6$/ml. In other aspects, the concentration used can be from about $1\times10^5$/ml to $1\times10^6$/ml, and any integer value in between.

In other aspects, the cells may be incubated on a rotator for varying lengths of time at varying speeds at either 2-10° C. or at room temperature.

In one embodiment, a plurality of the immune effector cells of the population do not express diaglycerol kinase (DGK), e.g., is DGK-deficient. In one embodiment, a plurality of the immune effector cells of the population do not express Ikaros, e.g., is Ikaros-deficient. In one embodiment, a plurality of the immune effector cells of the population do not express DGK and Ikaros, e.g., is both DGK and Ikaros-deficient.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" Clinical & Translational Immunology (2015) 4, e31; doi:10.1038/cti.2014.31.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Allogeneic CAR

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta) or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some embodiments, downregulation of HLA may be accomplished by reducing or eliminating expression of beta-2 microglobulin (B2M).

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not express or expresses at low levels an inhibitory molecule, e.g. by any mehod described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR and/or HLA and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR beta), in a cell, e.g., T cell.

Expression systems for siRNA and shRNAs, and exemplary shRNAs, are described, e.g., in paragraphs 649 and 650 of International Application WO2015/142675, filed Mar. 13, 2015, which is incorporated by reference in its entirety.

CRISPR to inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4

(VTCN1), HVEM (TNFRSF14 or CD270), KIR, A2aR, MHC class I, MHC class II, GAL9, adenosine, and TGFR beta), in a cell, e.g., T cell.

The CRISPR/Cas system, and uses thereof, are described, e.g., in paragraphs 651-658 of International Application WO2015/142675, filed Mar. 13, 2015, which is incorporated by reference in its entiretyTALEN to inhibit TCR and/or HLA "TALEN" or "TALEN to HLA and/or TCR" or "TALEN to inhibit HLA and/or TCR" refers to a transcription activator-like effector nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta), in a cell, e.g., T cell.

TALENs, and uses thereof, are described, e.g., in paragraphs 659-665 of International Application WO2015/142675, filed Mar. 13, 2015, which is incorporated by reference in its entirety.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta), in a cell, e.g., T cell.

ZFNs, and uses thereof, are described, e.g., in paragraphs 666-671 of International Application WO2015/142675, filed Mar. 13, 2015, which is incorporated by reference in its entirety.

Telomerase Expression

Telomeres play a crucial role in somatic cell persistence, and their length is maintained by telomerase (TERT). Telomere length in CLL cells may be very short (Roth et al., "Significantly shorter telomeres in T-cells of patients with ZAP-70+/CD38 chronic lymphocytic leukaemia" British Journal of Haematology, 143, 383-386., Aug. 28, 2008), and may be even shorter in manufactured CAR-expressing cells, e.g., CART19 cells, limiting their potential to expand after adoptive transfer to a patient. Telomerase expression can rescue CAR-expressing cells from replicative exhaustion.

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

Telomerase expression may be stable (e.g., the nucleic acid may integrate into the cell's genome) or transient (e.g., the nucleic acid does not integrate, and expression declines after a period of time, e.g., several days). Stable expression may be accomplished by transfecting or transducing the cell with DNA encoding the telomerase subunit and a selectable marker, and selecting for stable integrants. Alternatively or in combination, stable expression may be accomplished by site-specific recombination, e.g., using the Cre/Lox or FLP/FRT system.

Transient exprsesion may involve transfection or transduction wtih a nucleic acid, e.g., DNA or RNA such as mRNA. In some embodiments, transient mRNA transfection avoids the genetic instability sometimes associated with stable transfection with TERT. Transient expression of exogenous telomerase activity is described, e.g., in International Application WO2014/130909, which is incorporated by reference herein in its entirety. In embodiments, mRNA-based transfection of a telomerase subunit is performed according to the messenger RNA Therapeutics™ platform commercialized by Moderna Therapeutics. For instance, the method may be a method described in U.S. Pat. No. 8,710,200, 8,822,663, 8,680,069, 8,754,062, 8,664,194, or 8,680,069.

In an embodiment, hTERT has the amino acid sequence of GenBank Protein ID AAC51724.1 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795):

(SEQ ID NO: 5)
MPRAPRCRAVRSLLRSHYREVLPLATFVRRLGPQGWRLVQRGDPAAFRA

LVAQCLVCVPWDARPPPAAPSFRQVSCLKELVARVLQRLCERGAKNVLA

FGFALLDGARGGPPEAFTTSVRSYLPNTVTDALRGSGAWGLLLRRVGDD

VLVHLLARCALFVLVAPSCAYQVCGPPLYQLGAATQARPPPHASGPRRR

LGCERAWNHSVREAGVPLGLPAPGARRRGGSASRSLPLPKRPRRGAAPE

PERTPVGQGSWAHPGRTRGPSDRGFCVVSPARPAEEATSLEGALSGTRH

SHPSVGRQHHAGPPSTSRPPRPWDTPCPPVYAETKHFLYSSGDKEQLRP

SFLLSSLRPSLTGARRLVETIFLGSRPWMPGTPRRLPRLPQRYWQMRPL

FLELLGNHAQCPYGVLLKTHCPLRAAVTPAAGVCAREKPQGSVAAPEEE

DTDPRRLVQLLRQHSSPWQVYGFVRACLRRLVPPGLWGSRHNERRFLRN

TKKFISLGKHAKLSLQELTWKMSVRGCAWLRRSPGVGCVPAAEHRLREE

ILAKFLHWLMSVYVVELLRSFFYVTETTFQKNRLFFYRKSVWSKLQSIG

IRQHLKRVQLRELSEAEVRQHREARPALLTSRLRFIPKPDGLRPIVNMD

YVVGARTERREKRAERLTSRVKALFSVLNYERARRPGLLGASVLGLDDI

HRAWRTFVLRVRAQDPPPELYFVKVDVTGAYDTIPQDRLTEVIASIIKP

QNTYCVRRYAVVQKAAHGHVRKAFKSHVSTLTDLQPYMRQFVAHLQETS

PLRDAVVIEQSSSLNEASSGLFDVFLRFMCHHAVRIRGKSYVQCQGIPQ

GSILSTLLCSLCYGDMENKLFAGIRRDGLLLRLVDDELLVTPHLTHAKT

FLRTLVRGVPEYGCVVNLRKTVVNFPVEDEALGGTAFVQMPAHGLFPWC

GLLLDTRTLEVQSDYSSYARTSIRASLTFNRGFKAGRNMRRKLEGVLRL

KCHSLELDLQVNSLQTVCTNIYKILLLQAYRFHACVLQLPFHQQVWKNP

-continued

TFFLRVISDTASLCYSILKAKNAGMSLGAKGAAGPLPSEAVQWLCHQAF
LLKLTRHRVTYVPLLGSLRTAQTQLSRKLPGTTLTALEAAANPALPSDF
KTILD

In an embodiment, the hTERT has a sequence at least 80%, 85%, 90%, 95%, 96%, 97%, 98%, or 99% identical to the sequence of SEQ ID NO: 5. In an embodiment, the hTERT has a sequence of SEQ ID NO: 5. In an embodiment, the hTERT comprises a deletion (e.g., of no more than 5, 10, 15, 20, or 30 amino acids) at the N-terminus, the C-terminus, or both. In an embodiment, the hTERT comprises a transgenic amino acid sequence (e.g., of no more than 5, 10, 15, 20, or 30 amino acids) at the N-terminus, the C-terminus, or both.

In an embodiment, the hTERT is encoded by the nucleic acid sequence of GenBank Accession No. AF018167 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795):

```
                                                        (SEQ ID NO: 8)
     1  caggcagcgt ggtcctgctg cgcacgtggg aagccctggc cccggccacc cccgcgatgc
    61  cgcgcgctcc ccgctgccga gccgtgcgct ccctgctgcg cagccactac cgcgaggtgc
   121  tgccgctggc cacgttcgtg cggcgcctgg ggccccaggg ctggcggctg gtgcagcgcg
   181  gggacccggc ggctttccgc gcgctggtgg cccagtgcct ggtgtgcgtg ccctgggacg
   241  cacggccgcc ccccgccgcc ccctccttcc gccaggtgtc ctgcctgaag gagctggtgg
   301  cccgagtgct gcagaggctg tgcgagcgcg gcgcgaagaa cgtgctggcc ttcggcttcg
   361  cgctgctgga cggggcccgc gggggccccc ccgaggcctt caccaccagc gtgcgcagct
   421  acctgcccaa cacggtgacc gacgcactgc ggggagcgg ggcgtggggg ctgctgttgc
   481  gccgcgtggg cgacgacgtg ctggttcacc tgctggcacg ctgcgcgctc tttgtgctgg
   541  tggctcccag ctgcgcctac caggtgtgcg ggccgccgct gtaccagctc ggcgctgcca
   601  ctcaggcccg gccccccgcca cacgctagtg gaccccgaag gcgtctggga tgcgaacggg
   661  cctggaacca tagcgtcagg gaggccgggg tcccctgg cctgccagcc ccgggtgcga
   721  ggaggcgcgg gggcagtgcc agccgaagtc tgccgttgcc caagaggccc aggcgtggcg
   781  ctgcccctga gccggagcgg acgcccgttg ggcagggggtc ctgggcccac ccgggcagga
   841  cgcgtggacc gagtgaccgt ggtttctgtg tggtgtcacc tgccagaccc gccgaagaag
   901  ccacctcttt ggagggtgcg ctctctggca cgcgccactc ccacccatcc gtgggccgcc
   961  agcaccacgc gggccccca tccacatcgc ggccaccacg tccctgggac acgccttgtc
  1021  ccccggtgta cgccgagacc aagcacttcc tctactcctc aggcgacaag gagcagctgc
  1081  ggccctcctt cctactcagc tctctgaggc ccagcctgac tggcgctcgg aggctcgtgg
  1141  agaccatctt tctgggttcc aggccctgga tgccagggac tccccgcagg ttgccccgcc
  1201  tgccccagcg ctactggcaa atgcggcccc tgtttctgga gctgcttggg aaccacgcgc
  1261  agtgccccta cggggtgctc ctcaagacgc actgcccgct gcgagctgcg gtcaccccag
  1321  cagccggtgt ctgtgccgg gagaagcccc agggctctgt ggcggccccc gaggaggagg
  1381  acacagaccc ccgtcgcctg gtgcagctgc tccgccagca cagcagcccc tggcaggtgt
  1441  acggcttcgt gcgggcctgc ctgcgccggc tggtgccccc aggcctctgg ggctccaggc
  1501  acaacgaacg ccgcttcctc aggaacacca agaagttcat ctccctgggg aagcatgcca
  1561  agctctcgct gcaggagctg acgtggaaga tgagcgtgcg gggctgcgct tggctgcgca
  1621  ggagcccagg ggttggctgt gttccggccg cagagcaccg tctgcgtgag gagatcctgg
  1681  ccaagttcct gcactggctg atgagtgtgt acgtcgtcga gctgctcagg tctttctttt
  1741  atgtcacgga gaccacgttt caaaagaaca ggctcttttt ctaccggaag agtgtctgga
  1801  gcaagttgca aagcattgga atcagacagc acttgaagag ggtgcagctg cgggagctgt
  1861  cggaagcaga ggtcaggcag catcgggaag ccaggcccgc cctgctgacg tccagactcc
  1921  gcttcatccc caagcctgac gggctgcggc cgattgtgaa catggactac gtcgtgggag
```

```
-continued 1981   ccagaacgtt ccgcagagaa aagagggccg agcgtctcac ctcgagggtg aaggcactgt 2041   tcagcgtgct caactacgag cgggcgcggc gccccggcct cctgggcgcc tctgtgctgg 2101   gcctggacga tatccacagg gcctggcgca ccttcgtgct gcgtgtgcgg gcccaggacc 2161   cgccgcctga gctgtacttt gtcaaggtgg atgtgacggg cgcgtacgac accatccccc 2221   aggacaggct cacggaggtc atcgccagca tcatcaaacc ccagaacacg tactgcgtgc 2281   gtcggtatgc cgtggtccag aaggccgccc atgggcacgt ccgcaaggcc ttcaagagcc 2341   acgtctctac cttgacagac ctccagccgt acatgcgaca gttcgtggct cacctgcagg 2401   agaccagccc gctgagggat gccgtcgtca tcgagcgagg ctcctccctg aatgaggcca 2461   gcagtggcct cttcgacgtc ttcctacgct tcatgtgcca ccacgccgtg cgcatcaggg 2521   gcaagtccta cgtccagtgc caggggatcc cgcagggctc catcctctcc acgctgctct 2581   gcagcctgtg ctacggcgac atggagaaca agctgtttgc ggggattcgg cgggacgggc 2641   tgctcctgcg tttggtggat gatttcttgt tggtgacacc tcacctcacc cacgcgaaaa 2701   ccttcctcag gacccctggtc cgaggtgtcc ctgagtatgg ctgcgtggtg aacttgcgga 2761   agacagtggt gaacttccct gtagaagacg aggccctggg tggcacggct tttgttcaga 2821   tgccggccca cggcctattc ccctggtgcg gcctgctgct ggatacccgg accctggagg 2881   tgcagagcga ctactccagc tatgcccgga cctccatcag agccagtctc accttcaacc 2941   gcggcttcaa ggctgggagg aacatgcgtc gcaaactctt tgggtcttg cggctgaagt 3001   gtcacagcct gttctggat ttgcaggtga acagcctcca gacggtgtgc accaacatct 3061   acaagatcct cctgctgcag gcgtacaggt tcacgcatg tgtgctgcag ctcccattc 3121   atcagcaagt ttggaagaac cccacatttt tcctgcgcgt catctctgac acggcctccc 3181   tctgctactc catcctgaaa gccaagaacg cagggatgtc gctggggcc aagggcgccg 3241   ccggccctct gccctccgag gccgtgcagt ggctgtgcca ccaagcattc ctgctcaagc 3301   tgactcgaca ccgtgtcacc tacgtgccac tcctggggtc actcaggaca gcccagacgc 3361   agctgagtcg gaagctcccg gggacgacgc tgactgccct ggaggccgca gccaacccgg 3421   cactgccctc agacttcaag accatcctgg actgatggcc accgcccac agccaggcca 3481   agagcagaca ccagcagccc tgtcacgccg ggctctacgt cccaggggagg gaggggcggc 3541   ccacacccag gcccgcaccg ctgggagtct gaggcctgag tgagtgtttg gccgaggcct 3601   gcatgtccgg ctgaaggctg agtgtccggc tgaggcctga gcgagtgtcc agccaaggc 3661   tgagtgtcca gcacacctgc cgtcttcact tccccacagg ctggcgctcg gctccaccc 3721   agggccagct tttcctcacc aggagcccgg cttccactcc ccacatagga atagtccatc 3781   cccagattcg ccattgttca cccctcgccc tgccctcctt tgccttccac cccaccatc 3841   caggtggaga ccctgagaag gaccctggga gctctgggaa tttggagtga ccaaaggtgt 3901   gccctgtaca caggcgagga ccctgcacct ggatgggggt ccctgtgggt caaattgggg 3961   ggaggtgctg tgggagtaaa atactgaata tatgagtttt tcagttttga aaaaaaaaa 4021   aaaaaaa
```

In an embodiment, the hTERT is encoded by a nucleic acid having a sequence at least 80%, 85%, 90%, 95%, 96%, 97%, 98%, or 99% identical to the sequence of SEQ ID NO: 8. In an embodiment, the hTERT is encoded by a nucleic acid of SEQ ID NO: 8.

Chimeric Antigen Receptor (CAR)

The present invention provides immune effector cells (e.g., T cells, NK cells) that are engineered to contain one or more CARs that direct the immune effector cells to cancer. This is achieved through an antigen binding domain on the CAR that is specific for a cancer associated antigen. There are two classes of cancer associated antigens (tumor antigens) that can be targeted by the CARs described herein: (1) cancer associated antigens that are expressed on the surface of cancer cells; and (2) cancer associated antigens that itself is intracelular, however, a fragment of such antigen (peptide)

is presented on the surface of the cancer cells by MHC (major histocompatibility complex).

Accordingly, an immune effector cell, e.g., obtained by a method described herein, can be engineered to contain a CAR that target one of the following cancer associated antigens (tumor antigens): CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bD-Galp(1-4)bDGicp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CALX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope.

In certain embodiments, the antibody molecule is a multispecific (e.g., a bispecific or a trispecific) antibody molecule. Protocols for generating bispecific or heterodimeric antibody molecules, and various configurations for bispecific antibody molecules, are described in, e.g., paragraphs 455-458 of WO2015/142675, filed Mar. 13, 2015, which is incorporated by reference in its entirety.

In one aspect, the bispecific antibody molecule is characterized by a first immunoglobulin variable domain sequence, e.g., a scFv, which has binding specificity for CD19, e.g., comprises a scFv as described herein, or comprises the light chain CDRs and/or heavy chain CDRs from a scFv described herein, and a second immunoglobulin variable domain sequence that has binding specificity for a second epitope on a different antigen.

Chimeric TCR

In one aspect, the antibodies and antibody fragments of the present invention (e.g., CD19 antibodies and fragments) can be grafted to one or more constant domain of a T cell receptor ("TCR") chain, for example, a TCR alpha or TCR beta chain, to create a chimeric TCR. Without being bound by theory, it is believed that chimeric TCRs will signal through the TCR complex upon antigen binding. For example, an scFv as disclosed herein, can be grafted to the constant domain, e.g., at least a portion of the extracellular constant domain, the transmembrane domain and the cytoplasmic domain, of a TCR chain, for example, the TCR alpha chain and/or the TCR beta chain. As another example, an antibody fragment, for example a VL domain as described herein, can be grafted to the constant domain of a TCR alpha chain, and an antibody fragment, for example a VH domain as described herein, can be grafted to the constant domain of a TCR beta chain (or alternatively, a VL domain may be grafted to the constant domain of the TCR beta chain and a VH domain may be grafted to a TCR alpha chain). As another example, the CDRs of an antibody or antibody fragment may be grafted into a TCR alpha and/or beta chain to create a chimeric TCR. For example, the LCDRs disclosed herein may be grafted into the variable domain of a TCR alpha chain and the HCDRs disclosed herein may be grafted to the variable domain of a TCR beta chain, or vice versa. Such chimeric TCRs may be produced, e.g., by methods known in the art (For example, Willemsen R A et al, Gene Therapy 2000; 7: 1369-1377; Zhang T et al, Cancer Gene Ther 2004; 11: 487-496; Aggen et al, Gene Ther. 2012 April; 19(4):365-74).

Non-Antibody Scaffolds

In embodiments, the antigen binding domain comprises a non-antibody scaffold, e.g., a fibronectin, ankyrin, domain antibody, lipocalin, small modular immuno-pharmaceutical, maxybody, Protein A, or affilin. The non-antibody scaffold has the ability to bind to target antigen on a cell. In embodiments, the antigen binding domain is a polypeptide or fragment thereof of a naturally occurring protein expressed on a cell. In some embodiments, the antigen binding domain comprises a non-antibody scaffold. A wide variety of non-antibody scaffolds can be employed so long as the resulting polypeptide includes at least one binding region which specifically binds to the target antigen on a target cell.

Non-antibody scaffolds include: fibronectin (Novartis, MA), ankyrin (Molecular Partners AG, Zurich, Switzerland), domain antibodies (Domantis, Ltd., Cambridge, MA, and Ablynx nv, Zwijnaarde, Belgium), lipocalin (Pieris Proteolab AG, Freising, Germany), small modular immuno-pharmaceuticals (Trubion Pharmaceuticals Inc., Seattle, WA), maxybodies (Avidia, Inc., Mountain View, CA), Protein A (Affibody AG, Sweden), and affilin (gamma-crystallin or ubiquitin) (Scil Proteins GmbH, Halle, Germany).

In an embodiment the antigen binding domain comprises the extracellular domain, or a counter-ligand binding fragment thereof, of molecule that binds a counterligand on the surface of a target cell.

The immune effector cells can comprise a recombinant DNA construct comprising sequences encoding a CAR, wherein the CAR comprises an antigen binding domain (e.g., antibody or antibody fragment, TCR or TCR fragment) that binds specifically to a tumor antigen, e.g., an tumor antigen described herein, and an intracellular signaling domain. The intracellular signaling domain can comprise a costimulatory signaling domain and/or a primary signaling domain, e.g., a zeta chain. The costimulatory signaling domain refers to a portion of the CAR comprising at least a portion of the intracellular domain of a costimulatory molecule. As described elsewhere, the methods described herein can include transducing a cell, e.g., from the population of T regulatory-depleted cells, with a nucleic acid encoding a CAR, e.g., a CAR described herein.

In specific aspects, a CAR comprises a scFv domain, wherein the scFv may be preceded by an optional leader sequence such as provided in SEQ ID NO: 1, and followed by an optional hinge sequence such as provided in SEQ ID NO:2 or SEQ ID NO:36 or SEQ ID NO:23, a transmembrane region such as provided in SEQ ID NO:6, an intracellular signalling domain that includes SEQ ID NO:7 or SEQ ID NO:16 and a CD3 zeta sequence that includes SEQ ID NO:9 or SEQ ID NO:10, e.g., wherein the domains are contiguous with and in the same reading frame to form a single fusion protein.

In one aspect, an exemplary CAR constructs comprise an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), and an intracellular stimulatory domain (e.g., an intracellular stimulatory domain described herein). In one aspect, an exemplary CAR construct comprises an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), an intracellular costimulatory signaling domain (e.g., a costimulatory signaling domain described herein) and/or an intracellular primary signaling domain (e.g., a primary signaling domain described herein).

An exemplary leader sequence is provided as SEQ ID NO: 1. An exemplary hinge/spacer sequence is provided as SEQ ID NO: 2 or SEQ ID NO:36 or SEQ ID NO:23. An exemplary transmembrane domain sequence is provided as SEQ ID NO:6. An exemplary sequence of the intracellular signaling domain of the 4-1BB protein is provided as SEQ ID NO: 7. An exemplary sequence of the intracellular signaling domain of CD27 is provided as SEQ ID NO:16. An exemplary CD3zeta domain sequence is provided as SEQ ID NO: 9 or SEQ ID NO:10.

In one aspect, the immune effector cell comprises a recombinant nucleic acid construct comprising a nucleic acid molecule encoding a CAR, wherein the nucleic acid molecule comprises a nucleic acid sequence encoding an antigen binding domain, wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, CD27, 4-1BB, and the like. In some instances, the CAR can comprise any combination of CD3-zeta, CD28, 4-1BB, and the like.

The nucleic acid sequences coding for the desired molecules can be obtained using recombinant methods known in the art, such as, for example by screening libraries from cells expressing the nucleic acid molecule, by deriving the nucleic acid molecule from a vector known to include the same, or by isolating directly from cells and tissues containing the same, using standard techniques. Alternatively, the nucleic acid of interest can be produced synthetically, rather than cloned.

Nucleic acids encoding a CAR can be introduced into the immune effector cells using, e.g., a retroviral or lentiviral vector construct.

Nucleic acids encoding a CAR can also be introduced into the immune effector cell using, e.g., an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a polyA tail, typically 50-2000 bases in length (e.g., described herein, e.g., SEQ ID NO:35). RNA so produced can efficiently transfect different kinds of cells. In one embodiment, the template includes sequences for the CAR. In an embodiment, an RNA CAR vector is transduced into a cell, e.g., a T cell by electroporation.

Antigen Binding Domain

In one aspect, a plurality of the immune effector cells, e.g., the population of T regulatory-depleted cells, include a nucleic acid encoding a CAR that comprises a target-specific binding element otherwise referred to as an antigen binding domain. The choice of binding element depends upon the type and number of ligands that define the surface of a target cell. For example, the antigen binding domain may be chosen to recognize a ligand that acts as a cell surface marker on target cells associated with a particular disease state. Thus, examples of cell surface markers that may act as ligands for the antigen binding domain in a CAR described herein include those associated with viral, bacterial and parasitic infections, autoimmune disease and cancer cells.

In one aspect, the portion of the CAR comprising the antigen binding domain comprises an antigen binding domain that targets a tumor antigen, e.g., a tumor antigen described herein.

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, a T cell receptor (TCR), or a fragment there of, e.g., single chain TCR, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

In an embodiment, the antigen binding domain comprises an anti-CD19 antibody, or fragment thereof, e.g., an scFv. For example, the antigen binding domain comprises a variable heavy chain and a variable light chain listed in Table 1. The linker sequence joining the variable heavy and variable light chains can be, e.g., any of the linker sequences described herein, or alternatively, can be GST-SGSGKPGSGEGSTKG (SEQ ID NO:104).

TABLE 1

| Anti-CD19 antibody binding domains | | | | |
|---|---|---|---|---|
| | | | | SEQ ID NO: |
| CD19 | huscFv1 | EIVMTQSPATLSLSPGERATLSCRASQDISKYLNWYQQKPGQA PRLLIYHTSRLHSGIPARFSGSGSGTDYTLTISSLQPEDFAVY FCQQGNTLPYTFGQGTKLEIKGGGGSGGGGSGGGGSQVQLQES GPGLVKPSETLSLTCTVSGVSLPDYGVSWIRQPPGKGLEWIGV IWGSETTYYSSSLKSRVTISKDNSKNQVSLKLSSVTAADTAVY YCAKHYYYGGSYAMDYWGQGTLVTVSS | | 107 |
| CD19 | huscFv2 | Eivmtqspatlslspgeratlscrasqdiskylnwyqqkpgqaprll iyhtsrlhsgiparfsgsgsgtdytltisslqpedfavyfcqqgntl pytfgqgtkleikggggsggggsggggsqvqlqesgpglvkpsetls ltctvsgvslpdygvswirqppgkglewigviwgsettyyqsslksr vtiskdnsknqvslklssvtaadtavyycakhyyyggsyamdywgqg tivtvss | | 108 |
| CD19 | huscFv3 | Qvqlqesgpglvkpsetlsltctvsgvslpdygvswirqppgkglew igviwgsettyyssslksrvtiskdnsknqvslklssvtaadtavyy cakhyyyggsyamdywgqgtivtvssggggsggggsggggseivmtq spatlslspgeratlscrasqdiskylnwyqqkpgqaprlliyhtsr lhsgiparfsgsgsgtdytltisslqpedfavyfcqqgntlpytfgq gtkleik | | 109 |
| CD19 | huscFv4 | Qvqlqesgpglvkpsetlsltctvsgvslpdygvswirqppgkglew igviwgsettyyqsslksrvtiskdnsknqvslklssvtaadtavyy cakhyyyggsyamdywgqgtivtvssggggsggggsggggseivmtq spatlslspgeratlscrasqdiskylnwyqqkpgqaprlliyhtsr lhsgiparfsgsgsgtdytltisslqpedfavyfcqqgntlpytfgq gtkleik | | 110 |

TABLE 1-continued

Anti-CD19 antibody binding domains

| | | | |
|---|---|---|---|
| CD19 | huscFv5 | Eivmtqspatlslspgeratlscrasqdiskylnwyqqkpgqaprll iyhtsrlhsgiparfsgsgsgtdytltisslqpedfavyfcqqgntl pytfgqgtkleik<u>ggggsggggsggggsggggs</u>qvqlqesgpglvkp setlsltctvsgvslpdygvswirqppgkglewigviwgsettyyss slksrvtiskdnsknqvslklssvtaadtavyycakhyyyggsyamd ywgqgtivtvss | 111 |
| CD19 | huscFv6 | Eivmtqspatlslspgeratlscrasqdiskylnwyqqkpgqaprll iyhtsrlhsgiparfsgsgsgtdytltisslqpedfavyfcqqgntl pytfgqgtkleik<u>ggggsggggsggggsggggs</u>qvqlqesgpglvkp setlsltctvsgvslpdygvswirqppgkglewigviwgsettyyqs slksrvtiskdnsknqvslklssvtaadtavyycakhyyyggsyamd ywgqgtivtvss | 112 |
| CD19 | huscFv7 | Qvqlqesgpglvkpsetlsltctvsgvslpdygvswirqppgkglew igviwgsettyyssslksrvtiskdnsknqvslklssvtaadtavyy cakhyyyggsyamdywgqgtivtvss<u>ggggsggggsggggsggggs</u>e ivmtqspatlslspgeratlscrasqdiskylnwyqqkpgqaprlli yhtsrlhsgiparfsgsgsgtdytltisslqpedfavyfcqqgntlp ytfgqgtkleik | 113 |
| CD19 | huscFv8 | Qvqlqesgpglvkpsetlsltctvsgvslpdygvswirqppgkglew igviwgsettyyqsslksrvtiskdnsknqvslklssvtaadtavyy cakhyyyggsyamdywgqgtivtvss<u>ggggsggggsggggsggggs</u>e ivmtqspatlslspgeratlscrasqdiskylnwyqqkpgqaprlli yhtsrlhsgiparfsgsgsgtdytltisslqpedfavyfcqqgntlp ytfgqgtkleik | 114 |
| CD19 | huscFv9 | Eivmtqspatlslspgeratlscrasqdiskylnwyqqkpgqaprll iyhtsrlhsgiparfsgsgsgtdytltisslqpedfavyfcqqgntl pytfgqgtkleik<u>ggggsggggsggggsggggs</u>qvqlqesgpglvkp setlsltctvsgvslpdygvswirqppgkglewigviwgsettyyns slksrvtiskdnsknqvslklssvtaadtavyycakhyyyggsyamd ywgqgtivtvss | 115 |
| CD19 | HuscFv10 | Qvqlqesgpglvkpsetlsltctvsgvslpdygvswirqppgkglew igviwgsettyynsslksrvtiskdnsknqvslklssvtaadtavyy cakhyyyggsyamdywgqgtivtvss<u>ggggsggggsggggsggggs</u>e ivmtqspatlslspgeratlscrasqdiskylnwyqqkpgqaprlli yhtsrlhsgiparfsgsgsgtdytltisslqpedfavyfcqqgntlp ytfgqgtkleik | 116 |
| CD19 | HuscFv11 | Eivmtqspatlslspgeratlscrasqdiskylnwyqqkpgqaprll iyhtsrlhsgiparfsgsgsgtdytltisslqpedfavyfcqqgntl pytfgqgtkleik<u>ggggsggggsggggs</u>qvqlqesgpglvkpsetls ltctvsgvslpdygvswirqppgkglewigviwgsettyynsslksr vtiskdnsknqvslklssvtaadtavyycakhyyyggsyamdywgqg tivtvss | 117 |
| CD19 | HuscFv12 | Qvqlqesgpglvkpsetlsltctvsgvslpdygvswirqppgkglew igviwgsettyynsslksrvtiskdnsknqvslklssvtaadtavyy cakhyyyggsyamdywgqgtivtvss<u>ggggsggggsggggs</u>eivmtq spatlslspgeratlscrasqdiskylnwyqqkpgqaprlliyhtsr lhsgiparfsgsgsgtdytltisslqpedfavyfcqqgntlpytfgq gtkleik | 118 |
| CD19 | muCTL019 | Niqmtqttsslsaslgdrvtiscrasqdiskylnwyqqkpdgtvkll iyhtsrlhsgvpsrfsgsgsgtdysltisnleqediatyfcqqgntl pytfgggtkleit<u>ggggsggggsggggs</u>evklqesgpglvapsqsls vtctvsgvslpdygvswirqpprkglewlgviwgsettyynsalksr ltiikdnsksqvflkmnslqtddtaiyycakhyyyggsyamdywgqg tsvtvss | 119 |

| Antibody | VH Sequence | VL Sequence |
|---|---|---|
| SSJ25-C1 | QVQLLESGAELVRPGSSVKISCKASGYAFSS YWMNWVKQRPGQGLEWIGQIYPGDGDTNYNG KFKGQATLTADKSSSTAYMQLSGLTSEDSAV YSCARKTISSVVDFYFDYWGQGTTVT | ELVLTQSPKFMSTSVGDRVSVTCKASQNVGT NVAWYQQKPGQSPKPLIYSATYRNSGVPDRF TGSGSGTDFTLTITNVQSKDLADYFFCQYN RYPYTSGGGTKLEIKRRS |
| SEQ ID NO: | 120 | 121 |

CD19 CAR constructs containing humanized anti-CD19 scFv domains are described in PCT publication WO 2014/153270, incorporated herein by reference.

The sequences of murine and humanized CDR sequences of the anti-CD19 scFv domains are shown in Table 7 for the heavy chain variable domains and in Table 8 for the light chain variable domains. "ID" stands for the respective SEQ ID NO for each CDR.

able heavy chain and a variable light chain described in US2014/0322212A1 or US2016/0068601A1. Anti-CD123 CAR constructs containing anti-CD123 scFv domains are described herein, e.g., in US2014/0322212A1 or US2016/0068601A1, both incorporated herein by reference.

In embodiments, the antigen binding domain comprises an anti-mesothelin antibody, or fragment thereof, e.g., an scFv. For example, the antigen binding domain comprises a

TABLE 7

Heavy Chain Variable Domain CDRs (Kabat) of CD19 Antibodies

| Candidate | FW | HCDR1 | ID | HCDR2 | ID | HCDR3 | ID |
|---|---|---|---|---|---|---|---|
| murine_CART19 | | GVSLPDYGVS | 122 | VIWGSETTYYNSALKS | 123 | HYYYGGSYAMDY | 127 |
| humanized_CART19 a | VH4 | GVSLPDYGVS | 122 | VIWGSETTYYSSSLKS | 124 | HYYYGGSYAMDY | 127 |
| humanized_CART19 b | VH4 | GVSLPDYGVS | 122 | VIWGSETTYYQSSLKS | 125 | HYYYGGSYAMDY | 127 |
| humanized_CART19 c | VH4 | GVSLPDYGVS | 122 | VIWGSETTYYNSSLKS | 126 | HYYYGGSYAMDY | 127 |

TABLE 8

Light Chain Variable Domain CDRs of CD19 Antibodies

| Candidate | FW | LCDR1 | ID | LCDR2 | ID | LCDR3 | ID |
|---|---|---|---|---|---|---|---|
| murine_CART19 | | RASQDISKYLN | 128 | HTSRLHS | 129 | QQGNTLPYT | 130 |
| humanized_CART19 a | VK3 | RASQDISKYLN | 128 | HTSRLHS | 129 | QQGNTLPYT | 130 |
| humanized_CART19 b | VK3 | RASQDISKYLN | 128 | HTSRLHS | 129 | QQGNTLPYT | 130 |
| humanized_CART19 c | VK3 | RASQDISKYLN | 128 | HTSRLHS | 129 | QQGNTLPYT | 130 |

Any known CD19 CAR, e.g., the CD19 antigen binding domain of any known CD19 CAR, in the art can be used in accordance with the present disclosure. For example, LG-740; CD19 CAR described in the U.S. Pat. Nos. 8,399,645; 7,446,190; Xu et al., Leuk Lymphoma. 2013 54(2): 255-260(2012); Cruz et al., Blood 122(17):2965-2973 (2013); Brentjens et al., Blood, 118(18):4817-4828 (2011); Kochenderfer et al., Blood 116(20):4099-102 (2010); Kochenderfer et al., Blood 122 (25):4129-39(2013); and 16th Annu Meet Am Soc Gen Cell Ther (ASGCT) (May 15-18, Salt Lake City) 2013, Abst 10.

In an embodiment, the antigen binding domain comprises an anti-BCMA antibody, or fragment thereof, e.g., an scFv. For example, the antigen binding domain comprises a variable heavy chain and a variable light chain listed in Table 11. The linker sequence joining the variable heavy and variable light chains can be, e.g., any of the linker sequences described herein. Anti-BCMA CAR constructs containing anti-BCMA scFv domains are described herein, e.g., in Table 11, or in US2016/0046724A1, incorporated herein by reference.

In embodiments, the antigen binding domain comprises an EGFRvIII antibody, or fragment thereof, e.g., an scFv. For example, the antigen binding domain comprises a variable heavy chain and a variable light chain described in US2014/0322275A1. Anti-EGFRvIII CAR constructs containing anti-EGFRvIII scFv domains are described herein, e.g., in US2014/0322275A1, incorporated herein by reference. In embodiments, the antigen binding domain comprises a CD123 antibody, or fragment thereof, e.g., an scFv. For example, the antigen binding domain comprises a varivariable heavy chain and a variable light chain described in WO 2015/090230. Anti-mesothelin CAR constructs containing anti-mesothelin scFv domains are described herein, e.g., in WO 2015/090230, incorporated herein by reference.

In embodiments, the antigen binding domain comprises an anti-CLL1 antibody, or fragment thereof, e.g., an scFv. For example, the antigen binding domain comprises a variable heavy chain and a variable light chain described in US2016/0051651A1. Anti-CLL1 CAR constructs containing anti-CLL1 scFv domains are described herein, e.g., in US2016/0051651A1, incorporated herein by reference.

In embodiments, the antigen binding domain comprises an anti-CD33 antibody, or fragment thereof, e.g., an scFv. For example, the antigen binding domain comprises a variable heavy chain and a variable light chain described in US2016/0096892A1. Anti-CD33 CAR constructs containing anti-CD33 scFv domains are described herein, e.g., in US2016/0096892A1, incorporated herein by reference.

In one embodiment, the antigen binding domain comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed or described above.

In one aspect, the anti-tumor antigen binding domain is a fragment, e.g., a single chain variable fragment (scFv). In one aspect, the anti-a cancer associate antigen as described herein binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a cancer associate antigen as described herein protein with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as (Gly$_4$Ser)n, where n is a positive integer equal to or greater than 1 (SEQ ID NO:26). In one embodiment, the linker can be (Gly$_4$Ser)$_4$ (SEQ ID NO:27) or (Gly$_4$Ser)$_3$ (SEQ ID NO:28). Variation in the linker length may retain or enhance activity, giving rise to superior efficacy in activity studies.

In another aspect, the antigen binding domain is a T cell receptor ("TCR"), or a fragment thereof, for example, a single chain TCR (scTCR). Methods to make such TCRs are known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contains the Vα and Vβ genes from a T cell clone linked by a linker (e.g., a flexible peptide). This approach is very useful to cancer associated target that itself is intracellar, however, a fragment of such antigen (peptide) is presented on the surface of the cancer cells by MHC.

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect, the amino acid sequence of the transmembrane domain may be modified or substituted so as to minimize interactions with the binding domains of the native binding partner present in the same CART.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIR2DS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one embodiment, the hinge or spacer comprises (e.g., consists of) the amino acid sequence of SEQ ID NO:2. In one aspect, the transmembrane domain comprises (e.g., consists of) a transmembrane domain of SEQ ID NO: 6.

In one aspect, the hinge or spacer comprises an IgG4 hinge. For example, in one embodiment, the hinge or spacer comprises a hinge of the amino acid sequence (SEQ ID NO: 36)
ESKYGPPCPPCPAPEFLGGPSVFLFPPKPKDTLMISRTPEVTCVVVD

VSQEDPEVQFNWYVDGVEVHNAKTKPREEQFNSTYRVVSVLTVLHQD

WLNGKEYKCKVSNKGLPSSIEKTISKAKGQPREPQVYTLPPSQEEMT

KNQVSLTCLVKGFYPSDIAVEWESNGQPENNYKTTPPVLDSDGSFFL

YSRLTVDKSRWQEGNVFSCSVMHEALHNHYTQKSLSLSLGKM.

In some embodiments, the hinge or spacer comprises a hinge encoded by a nucleotide sequence of (SEQ ID NO: 37)
GAGAGCAAGTACGGCCCTCCCTGCCCCCCTTGCCCTGCCCCCGAGTTCCT

GGGCGGACCCAGCGTGTTCCTGTTCCCCCCCAAGCCCAAGGACACCCTGA

TGATCAGCCGGACCCCCGAGGTGACCTGTGTGGTGGTGGACGTGTCCCAG

GAGGACCCCGAGGTCCAGTTCAACTGGTACGTGGACGGCGTGGAGGTGCA

CAACGCCAAGACCAAGCCCCGGGAGGAGCAGTTCAATAGCACCTACCGGG

TGGTGTCCGTGCTGACCGTGCTGCACCAGGACTGGCTGAACGGCAAGGAA

TACAAGTGTAAGGTGTCCAACAAGGGCCTGCCCAGCAGCATCGAGAAAAC

CATCAGCAAGGCCAAGGGCCAGCCTCGGGAGCCCCAGGTGTACACCCTGC

CCCCTAGCCAAGAGGAGATGACCAAGAACCAGGTGTCCCTGACCTGCCTG

GTGAAGGGCTTCTACCCCAGCGACATCGCCGTGGAGTGGGAGAGCAACGG

CCAGCCCGAGAACAACTACAAGACCACCCCCCCTGTGCTGGACAGCGACG

GCAGCTTCTTCCTGTACAGCCGGCTGACCGTGGACAAGAGCCGGTGGCAG

GAGGGCAACGTCTTTAGCTGCTCCGTGATGCACGAGGCCCTGCACAACCA

CTACACCCAGAAGAGCCTGAGCCTGTCCCTGGGCAAGATG.

In one aspect, the hinge or spacer comprises an IgD hinge. For example, in one embodiment, the hinge or spacer comprises a hinge of the amino acid sequence (SEQ ID NO: 23)
RWPESPKAQASSVPTAQPQAEGSLAKATTAPATTRNTGRGGEEKKKEKEK

EEQEERETKTPECPSHTQPLGVYLLTPAVQDLWLRDKATFTCFVVGSDLK

DAHLTWEVAGKVPTGGVEEGLLERHSNGSQSQHSRLTLPRSLWNAGTSVT

CTLNHPSLPPQRLMALREPAAQAPVKLSLNLLASSDPPEAASWLLCEVSG

FSPPNILLMWLEDQREVNTSGFAPARPPPQPGSTTFWAWSVLRVPAPPSP

QPATYTCVVSHEDSRTLLNASRSLEVSYVTDH.

In some embodiments, the hinge or spacer comprises a hinge encoded by a nucleotide sequence of (SEQ ID NO: 24)
AGGTGGCCCGAAAGTCCCAAGGCCCAGGCATCTAGTGTTCCTACTGCACA

GCCCCAGGCAGAAGGCAGCCTAGCCAAAGCTACTACTGCACCTGCCACTA

CGCGCAATACTGGCCGTGGCGGGAGGAGAAGAAAAAGGAGAAAGAGAAA

GAAGAACAGGAAGAGAGGGAGACCAAGACCCCTGAATGTCCATCCCATAC

CCAGCCGCTGGGCGTCTATCTCTTGACTCCCGCAGTACAGGACTTGTGGC

TTAGAGATAAGGCCACCTTTACATGTTTCGTCGTGGGCTCTGACCTGAAG

GATGCCCATTTGACTTGGGAGGTTGCCGGAAAGGTACCCACAGGGGGGT

TGAGGAAGGGTTGCTGGAGCGCCATTCCAATGGCTCTCAGAGCCAGCACT

CAAGACTCACCCTTCCGAGATCCCTGTGGAACGCCGGGACCTCTGTCACA

TGTACTCTAAATCATCCTAGCCTGCCCCCACAGCGTCTGATGGCCCTTAG

AGAGCCAGCCGCCCAGGCACCAGTTAAGCTTAGCCTGAATCTGCTCGCCA

GTAGTGATCCCCCAGAGGCCGCCAGCTGGCTCTTATGCGAAGTGTCCGGC

-continued
TTTAGCCCGCCCAACATCTTGCTCATGTGGCTGGAGGACCAGCGAGAAGT

GAACACCAGCGGCTTCGCTCCAGCCCGGCCCCCACCCCAGCCGGGTTCTA

CCACATTCTGGGCCTGGAGTGTCTTAAGGGTCCCAGCACCACCTAGCCCC

CAGCCAGCCACATACACCTGTGTTGTGTCCCATGAAGATAGCAGGACCCT

GCTAAATGCTTCTAGGAGTCTGGAGGTTTCCTACGTGACTGACCATT.

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO: 14). In some embodiments, the linker is encoded by a nucleotide sequence of

GGTGGCGGAGGTTCTGGAGGTGGAGGTTCC. (SEQ ID NO: 19)

In one aspect, the hinge or spacer comprises a KIR2DS2 hinge.

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced. The term "effector function" refers to a specialized function of a cell. Effector function of a T cell, for example, may be cytolytic activity or helper activity including the secretion of cytokines. Thus the term "intracellular signaling domain" refers to the portion of a protein which transduces the effector function signal and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

Examples of intracellular signaling domains for use in a CAR described herein include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, and CD66d. In one embodiment, a CAR of the invention comprises an intracellular signaling domain, e.g., a primary signaling domain of CD3-zeta, e.g., a CD3-zeta sequence described herein.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

The intracellular signalling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). Further examples of such costimulatory molecules include CDS, ICAM-1, GITR, BAFFR, HVEM (LIGHTR), SLAMF7, NKp80 (KLRF1), NKp30, NKp44, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, NKG2D, NKG2C and PAG/Cbp.

The intracellular signaling sequences within the cytoplasmic portion of the CAR may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 7. In one aspect, the signaling domain of CD3-zeta is a signaling domain of SEQ ID NO: 9.

In one aspect, the intracellular signaling domain is designed to comprise the signaling domain of CD3-zeta and the signaling domain of CD27. In one aspect, the signaling domain of CD27 comprises an amino acid sequence of (SEQ ID NO: 16)
QRRKYRSNKGESPVEPAEPCRYSCPREEEGSTIPIQEDYRKPEPACSP.

In one aspect, the signalling domain of CD27 is encoded by a nucleic acid sequence of (SEQ ID NO: 15)
AGGAGTAAGAGGAGCAGGCTCCTGCACAGTGACTACATGAACATGACTCC

CCGCCGCCCCGGGCCCACCCGCAAGCATTACCAGCCCTATGCCCCACCAC

GCGACTTCGCAGCCTATCGCTCC.

Co-Expression of CAR with Other Molecules or Agents
Co-Expression of a Second CAR In one aspect, the CAR-expressing cell described herein can further comprise a second CAR, e.g., a second CAR that includes a different antigen binding domain, e.g., to the same target (e.g., CD19) or a different target (e.g., a target other than a cancer associated antigen described herein, e.g., CD19 or a different cancer associated antigen described herein). In one embodiment, the second CAR includes an antigen binding domain to a target expressed the same cancer cell type as the cancer associated antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27, ICOS, or OX-40, onto the first CAR, and the primary signaling domain, e.g., CD3 zeta, on the second CAR can limit the CAR activity to cells where both targets are expressed. In one embodiment, the CAR expressing cell comprises a first cancer antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In one embodiment, the CAR-expressing cell comprises an XCAR described herein and an inhibitory CAR. In one embodiment, the inhibitory CAR comprises an antigen binding domain that binds an antigen found on normal cells but not cancer cells, e.g., normal cells that also express X. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (e.g., CEACAM-1, CEACAM-3, and/or CEACAM-5), LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, or TGFR (e.g., TGFRbeta).

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

In some embodiments, the antigen binding domain comprises a single domain antigen binding (SDAB) molecules include molecules whose complementary determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, lamprey, fish, shark, goat, rabbit, and bovine. This term also includes naturally occurring single domain antibody molecules from species other than Camelidae and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. et al. (1993) Nature 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from Camelidae species, for example in camel, llama, dromedary, alpaca and guanaco. Other species besides Camelidae may produce heavy chain molecules naturally devoid of light chain; such VHHs are within the scope of the invention.

The SDAB molecules can be recombinant, CDR-grafted, humanized, camelized, de-immunized and/or in vitro generated (e.g., selected by phage display).

It has also been discovered, that cells having a plurality of chimeric membrane embedded receptors comprising an antigen binding domain that interactions between the antigen binding domain of the receptors can be undesirable, e.g., because it inhibits the ability of one or more of the antigen binding domains to bind its cognate antigen. Accordingly, disclosed herein are cells having a first and a second non-naturally occurring chimeric membrane embedded receptor comprising antigen binding domains that minimize such interactions. Also disclosed herein are nucleic acids encoding a first and a second non-naturally occurring chimeric membrane embedded receptor comprising an antigen binding domains that minimize such interactions, as well as methods of making and using such cells and nucleic acids. In an embodiment the antigen binding domain of one of the first and the second non-naturally occurring chimeric membrane embedded receptor, comprises an scFv, and the other comprises a single VH domain, e.g., a camelid, shark, or lamprey single VH domain, or a single VH domain derived from a human or mouse sequence.

In some embodiments, the cell comprises a first and second CAR, wherein the antigen binding domain of one of the first CAR and the second CAR does not comprise a variable light domain and a variable heavy domain. In some embodiments, the antigen binding domain of one of the first CAR and the second CAR is an scFv, and the other is not an scFv. In some embodiments, the antigen binding domain of one of the first CAR and the second CAR comprises a single VH domain, e.g., a camelid, shark, or lamprey single VH domain, or a single VH domain derived from a human or mouse sequence. In some embodiments, the antigen binding domain of one of the first CAR and the second CAR comprises a nanobody. In some embodiments, the antigen binding domain of one of the first CAR and the second CAR comprises a camelid VHH domain.

In some embodiments, the antigen binding domain of one of the first CAR and the second CAR comprises an scFv, and the other comprises a single VH domain, e.g., a camelid, shark, or lamprey single VH domain, or a single VH domain derived from a human or mouse sequence. In some embodiments, the antigen binding domain of one of the first CAR and the second CAR comprises an scFv, and the other comprises a nanobody. In some embodiments, the antigen binding domain of one of the first CAR and the second CAR comprises an scFv, and the other comprises a camelid VHH domain.

In some embodiments, when present on the surface of a cell, binding of the antigen binding domain of the first CAR to its cognate antigen is not substantially reduced by the presence of the second CAR. In some embodiments, binding of the antigen binding domain of the first CAR to its cognate antigen in the presence of the second CAR is 85%, 90%, 95%, 96%, 97%, 98% or 99% of binding of the antigen binding domain of the first CAR to its cognate antigen in the absence of the second CAR.

In some embodiments, when present on the surface of a cell, the antigen binding domains of the first CAR and the second CAR, associate with one another less than if both were scFv antigen binding domains. In some embodiments, the antigen binding domains of the first CAR and the second CAR, associate with one another 85%, 90%, 95%, 96%, 97%, 98% or 99% less than if both were scFv antigen binding domains.

Co-Expression of an Agent that Enhances CAR Activity

In another aspect, the CAR-expressing cell described herein can further express another agent, e.g., an agent which enhances the activity of a CAR-expressing cell.

For example, in one embodiment, the agent can be an agent which inhibits a molecule that modulates or regulates, e.g., inhibits, T cell function. For example, in one embodiment, the agent can be an agent which inhibits an inhibitory molecule. Inhibitory molecules, e.g., PD1, can, in some embodiments, decrease the ability of a CAR-expressing cell to mount an immune effector response. Examples of inhibitory molecules include PD1, PD-L1, CTLA4, TIM3, LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, or TGFR beta.

In one embodiment, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used to inhibit expression of a molecule that modulates or regulates, e.g., inhibits, T-cell function in the CAR-expressing cell. In an embodiment the agent is an shRNA, e.g., an shRNA described herein. In an embodiment, the agent that modulates or regulates, e.g., inhibits, T-cell function is inhibited within a CAR-expressing cell. For example, a dsRNA molecule that inhibits expression of a molecule that modulates or regulates, e.g., inhibits, T-cell function is linked to the nucleic acid that encodes a component, e.g., all of the components, of the CAR.

In an embodiment, a nucleic acid molecule that encodes a dsRNA molecule that inhibits expression of the molecule that modulates or regulates, e.g., inhibits, T-cell function is operably linked to a promoter, e.g., a H1- or a U6-derived promoter such that the dsRNA molecule that inhibits expression of the molecule that modulates or regulates, e.g., inhibits, T-cell function is expressed, e.g., is expressed within a CAR-expressing cell. See e.g., Tiscornia G., "Development of Lentiviral Vectors Expressing siRNA," Chapter 3, in Gene Transfer: Delivery and Expression of DNA and RNA (eds. Friedmann and Rossi). Cold Spring Harbor Laboratory Press, Cold Spring Harbor, NY, USA, 2007; Brummelkamp T R, et al. (2002) Science 296: 550-553; Miyagishi M, et al. (2002) Nat. Biotechnol. 19: 497-500. In an embodiment the nucleic acid molecule that encodes a dsRNA molecule that inhibits expression of the molecule that modulates or regulates, e.g., inhibits, T-cell function is present on the same vector, e.g., a lentiviral vector, that comprises a nucleic acid molecule that encodes a component, e.g., all of the components, of the CAR. In such an embodiment, the nucleic acid molecule that encodes a dsRNA molecule that inhibits expression of the molecule that modulates or regulates, e.g., inhibits, T-cell function is located on the vector, e.g., the lentiviral vector, 5'- or 3'- to the nucleic acid that encodes a component, e.g., all of the components, of the CAR. The nucleic acid molecule that encodes a dsRNA molecule that inhibits expression of the molecule that modulates or regulates, e.g., inhibits, T-cell function can be transcribed in the same or different direction as the nucleic acid that encodes a component, e.g., all of the components, of the CAR. In an embodiment the nucleic acid molecule that encodes a dsRNA molecule that inhibits expression of the molecule that modulates or regulates, e.g., inhibits, T-cell function is present on a vector other than the vector that comprises a nucleic acid molecule that encodes a component, e.g., all of the components, of the CAR. In an embodiment, the nucleic acid molecule that encodes a dsRNA molecule that inhibits expression of the molecule that modulates or regulates, e.g., inhibits, T-cell function it transiently expressed within a CAR-expressing cell. In an embodiment, the nucleic acid molecule that encodes a dsRNA molecule that inhibits expression of the molecule that modulates or regulates, e.g., inhibits, T-cell function is stably integrated into the genome of a CAR-expressing cell. In an embodiment, the molecule that modulates or regulates, e.g., inhibits, T-cell function is PD-1.

In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, or TGFR beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1), fused to a transmembrane domain and intracellular signaling domains such as 41BB and CD3 zeta (also referred to herein as a PD1 CAR). In one embodiment, the PD1 CAR, when used in combination with a XCAR described herein, improves the persistence of the T cell. In one embodiment, the CAR is a PD1 CAR comprising the extracellular domain of PD1 indicated as underlined in SEQ ID NO: 105. In one embodiment, the PD1 CAR comprises the amino acid sequence of SEQ ID NO:105.

(SEQ ID NO: 105)
Malpvtalllplalllhaarppgwfldspdrpwnpptfspall
vvtegdnatftcsfsntsesfvlnwyrmspsnqtdklaafpedrsqpgqd
crfrvtqlpngrdfhmsvvrarrndsgtylcgaislapkaqikeslrael
rvterraevptahpspsprpagqfqtlvtttpaprpptpaptiasqplsl
rpeacrpaaggavhtrgldfacdiyiwaplagtcgvlllslvitlyckrg
rkkllyifkqpfmrpvqttqeedgcscrfpeeeeggcelrvkfsrsadap
aykqgqnqlynelnlgrreeydvldkrrgrdpemggkprrknpqeglyne
lqkdkmaeayseigmkgerrrgkghdglyqglstatkdtydalhmqalpp
r.

In one embodiment, the PD1 CAR comprises the amino acid sequence provided below (SEQ ID NO:106).

(SEQ ID NO: 106)
pgwfldspdrpwnpptfspallvvtegdnatftcsfsntsesf
vlnwyrmspsnqtdklaafpedrsqpgqdcrfrvtqlpngrdfhmsvvra
rrndsgtylcgaislapkaqikeslraelrvterraevptahpspsprpa
gqfqtlvtttpaprpptpaptiasqplslrpeacrpaaggavhtrgldfa
cdiyiwaplagtcgvlllslvitlyckrgrkkllyifkqpfmrpvqttqe
edgcscrfpeeeeggcelrvkfsrsadapaykqgqnqlynelnlgrreey
dvldkrrgrdpemggkprrknpqeglynelqkdkmaeayseigmkgerrr
gkghdglyqglstatkdtydalhmqalppr.

In one embodiment, the agent comprises a nucleic acid sequence encoding the PD1 CAR, e.g., the PD1 CAR described herein. In one embodiment, the nucleic acid sequence for the PD1 CAR is shown below, with the PD1 ECD underlined below in SEQ ID NO: 103

(SEQ ID NO: 103)
atggccctccctgtcactgccctgcttctcccctcgcactcc
tgctccacgccgctagaccacccggatggtttctggactctccggatcgc
ccgtggaatcccccaaccttctcaccggcactcttggttgtgactgaggg
cgataatgcgaccttcacgtgctcgttctccaacacctccgaatcattcg
tgctgaactggtaccgcatgagcccgtcaaaccagaccgacaagctcgcc
gcgtttccggaagatcggtcgcaacgggacaggattgtcggttccgcgt
gactcaactgccgaatggcagagacttccacatgagcgtggtccgcgcta
ggcgaaacgactccgggacctacctgtgcggagccatctcgctggcgcct
aaggcccaaatcaaagagagcttgagggccgaactgagagtgaccgagcg
cagagctgaggtgccaactgcacatccatccccatcgcctcggcctgcgg
ggcagtttcagaccctggtcacgaccactccggccgcgcgcccaccgact
ccggccccaactatcgcgagccagcccctgtcgctgaggccggaagcatg
ccgccctgccgccggaggtgctgtgcataccccggggattggacttcgcat
gcgacatctacatttgggctcctctcgccggaacttgtggcgtgctcctt
ctgtccctggtcatcacctgtactgcaagcggggtcggaaaaagcttct
gtacattttcaagcagcccttcatgaggcccgtgcaaaccacccaggagg aggacggttgctcctgccggttccccgaagaggaagaaggaggttgcgag
ctgcgcgtgaagttctcccggagcgccgacgccccgcctataagcaggg
ccagaaccagctgtacaacgaactgaacctgggacggcgggaagagtacg
atgtgctggacaagcggcgcggccgggaccccgaaatgggcgggaagcct
agaagaaagaaccctcaggaaggcctgtataacgagctgcagaaggacaa
gatggccgaggcctactccgaaattgggatgaagggagagcggcggaggg
gaaaggggcacgacggcctgtaccaaggactgtccaccgccaccaaggac
acatacgatgccctgcacatgcaggcccttcccctcgc.

In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206).). In an embodiment, the agent is an antibody or antibody fragment that binds to TIM3. In an embodiment, the agent is an antibody or antibody fragment that binds to LAG3. In an embodiment, the agent is an antibody or antibody fragment that binds to CEACAM (e.g., CEACAM-1, CEACAM-3 and/or CEACAM-5). In embodiments, the agent that enhances the activity of a CAR-expressing cell, e.g., inhibitor of an inhibitory molecule, is administered in combination with an allogeneic CAR, e.g., an allogeneic CAR described herein (e.g., described in the Allogeneic CAR section herein).

PD1 is an inhibitory member of the CD28 family of receptors that also includes CD28, CTLA-4, ICOS, and BTLA. PD1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et al. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

Antibodies, antibody fragments, and other inhibitors of PD1, PD-L1 and PD-L2 are known and may be used combination with a CD19 CAR described herein. For example, nivolumab (also referred to as BMS-936558 or MDX1106; Bristol-Myers Squibb) is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. Pidilizumab (CT-011; Cure Tech) is a humanized IgG1k monoclonal antibody that binds to PD1. Pidilizumab and other humanized anti-PD1 monoclonal antibodies are disclosed in WO2009/101611. Pembrolizumab (formerly known as lambrolizumab, and also referred to as Keytruda, MK03475; Merck) is a humanized IgG4 monoclonal antibody that binds to PD1. Pembrolizumab and other humanized anti-PD1 antibodies are disclosed in U.S. Pat. No. 8,354,509 and WO2009/114335. MEDI4736 (Medimmune) is a human monoclonal antibody that binds to PDLL, and inhibits interaction of the ligand with PD1. MDPL3280A (Genentech/Roche) is a human Fc optimized IgG1 monoclonal antibody that binds to PD-L1. MDPL3280A and other human monoclonal antibodies to PD-L1 are disclosed in U.S. Pat. No. 7,943,743 and U.S Publication No.: 20120039906. Other anti-PD-L1 binding agents include YW243.55.570 (heavy and light chain variable regions are shown in SEQ ID NOs 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD1 and B7-H1. Other anti-PD1 antibodies include AMP 514 (Amplimmune), among others, e.g., anti-PD1 antibodies disclosed in U.S. Pat. No. 8,609,089, US 2010028330, and/or US 20120114649.

In some embodiments, a PD1 inhibitor described herein (e.g., a PD1 antibody, e.g., a PD1 antibody described herein) is used combination with a CD19 CAR described herein to treat a disease associated with expression of CD19. In some embodiments, a PD-L1 inhibitor described herein (e.g., a PD-L1 antibody, e.g., a PD-L1 antibody described herein) is used combination with a CD19 CAR described herein to treat a disease associated with expression of CD19. The disease may be, e.g., a lymphoma such as DLBCL including primary DLBCL or secondary DLBCL. In some embodiments, the subject has, or is identified as having, at least 5%, 6%, 7%, 8%, 9%, 10%, 20%, 30%, 40%, 50%, 60%, 70%, 80%, or 90% of cancer cells, e.g., DLBCL cells, which are CD3+/PD1+. In some embodiments, the subject has, or is identified as having, substantially non-overlapping populations of CD19+ cells and PD-L1+ cells in a cancer, e.g., the cancer microenvironment. For instance, in some embodiments, less than 20%, 10%, 9%, 8%, 7%, 6%, 5%, 4%, 3%, 2%, or 1% of cells in the cancer, e.g., cancer microenvironment, are double positive for CD19 and PD-L1.

In some embodiments, the subject is treated with a combination of a CD19 CAR, a PD1 inhibitor, and a PD-L1 inhibitor. In some embodiments, the subject is treated with a combination of a CD19 CAR, a PD1 inhibitor, and a CD3 inhibitor. In some embodiments, the subject is treated with a combination of a CD19 CAR, a PD1 inhibitor, a PD-L1 inhibitor, and a CD3 inhibitor.

In some embodiments, the methods herein include a step of assaying cells in a biological sample, e.g., a sample comprising DLBCL cells, for CD3 and/or PD-1 (e.g., CD3 and/or PD-1 expression). In some embodiments, the methods include a step of assaying cells in a biological sample, e.g., a sample comprising DLBCL cells, for CD19 and/or PD-L1 (e.g., CD19 and/or PD-L1 expression). In some embodiments, the methods include, e.g., providing a sample comprising cancer cells and performing a detection step, e.g., by immunohistochemistry, for one or more of CD3, PD-1, CD19, or PD-L1. The methods may comprise a further step of recommending or administering a treatment, e.g., a treatment comprising a CD19 CAR.

In one embodiment, the anti-PD-1 antibody or fragment thereof is an anti-PD-1 antibody molecule as described in US 2015/0210769, entitled "Antibody Molecules to PD-1 and Uses Thereof," incorporated by reference in its entirety. In one embodiment, the anti-PD-1 antibody molecule includes at least one, two, three, four, five or six CDRs (or collectively all of the CDRs) from a heavy and light chain variable region from an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1, or a sequence substantially identical (e.g., at least 80%, 85%, 90%, 92%, 95%, 97%, 98%, 99% or higher identical) to any of the aforesaid sequences; or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-PD-1 antibody molecule comprises at least one, two, three or four variable regions from an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences.

TIM3 (T cell immunoglobulin-3) also negatively regulates T cell function, particularly in IFN-g-secreting CD4+T helper 1 and CD8+T cytotoxic 1 cells, and plays a critical role in T cell exhaustion. Inhibition of the interaction between TIM3 and its ligands, e.g., galectin-9 (Ga19), phosphatidylserine (PS), and HMGB1, can increase immune response. Antibodies, antibody fragments, and other inhibitors of TIM3 and its ligands are available in the art and may be used combination with a CD19 CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In one embodiment, the anti-TIM3 antibody or fragment thereof is an anti-TIM3 antibody molecule as described in US 2015/0218274, entitled "Antibody Molecules to TIM3 and Uses Thereof," incorporated by reference in its entirety. In one embodiment, the anti-TIM3 antibody molecule includes at least one, two, three, four, five or six CDRs (or collectively all of the CDRs) from a heavy and light chain variable region from an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-TIM3 antibody molecule comprises at least one, two, three or four variable regions from an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In other embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. *PLoS One.* 2010 Sep. 2; 5(9). pii: e12529 (DOI:10:1371/journal.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. *J Immunol.* 2002 Mar. 15; 168(6): 2803-10; Markel et al. *J Immunol.* 2006 Nov. 1; 177(9): 6062-71; Markel et al. *Immunology.* 2009 February; 126(2): 186-200; Markel et al. *Cancer Immunol Immunother.* 2010 February; 59(2):215-30; Ortenberg et al. *Mol Cancer Ther.* 2012 June; 11(6):1300-10; Stern et al. *J Immunol.* 2005 Jun. 1; 174(11):6692-701; Zheng et al. *PLoS One.* 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) *Nature* doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CD19 CAR described herein. For example, BMS-986016 (Bristol-Myers Squib) is a monoclonal antibody that targets LAG3. IMP701 (Immutep) is an antagonist LAG3 antibody and IMP731 (Immutep and GlaxoStnithKline) is a depleting LAG3 antibody. Other LAG3 inhibitors include IMP321. (Immutep), which is a recombinant fusion protein of a soluble portion of LAG3 and Ig that binds to MHC class II molecules and activates antigen presenting cells (APC). Other antibodies are disclosed, e.g., in WO2010/019570.

In one embodiment, the anti-LAG3 antibody or fragment thereof is an anti-LAG3 antibody molecule as described in US 2015/0259420, entitled "Antibody Molecules to LAG3 and Uses Thereof," incorporated by reference in its entirety. In one embodiment, the anti-LAG3 antibody molecule includes at least one, two, three, four, five or six CDRs (or collectively all of the CDRs) from a heavy and light chain variable region from an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Table 1; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-LAG3 antibody molecule comprises at least one, two, three or four variable regions from an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Tables 1; or a sequence substantially identical (e.g., at least 80%, 85%, 90%, 92%, 95%, 97%, 98%, 99% or higher identical) to any of the aforesaid sequences.

In another example, in one embodiment, the agent which enhances the activity of a CAR-expressing cell can be a costimulatory molecule or costimulatory molecule ligand. Examples of costimulatory molecules include an MHC class I molecule, a TNF receptor protein, an Immunoglobulin-like protein, a cytokine receptor, an integrins, a signalling lymphocytic activation molecule (SLAM protein), an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83, e.g., as described herein. Examples of costimulatory molecule ligands include CD80, CD86, CD40L, ICOSL, CD70, OX40L, 4-1BBL, GITRL, and LIGHT. In embodiments, the costimulatory molecule ligand is a ligand for a costimulatory molecule different from the costimulatory molecule domain of the CAR. In embodiments, the costimulatory molecule ligand is a ligand for a costimulatory molecule that is the same as the costimulatory molecule domain of the CAR. In an embodiment, the costimulatory molecule ligand is 4-1BBL. In an embodiment, the costimulatory ligand is CD80 or CD86. In an embodiment, the costimulatory molecule ligand is CD70. In embodiments, a CAR-expressing immune effector cell described herein can be further engineered to express one or more additional costimulatory molecules or costimulatory molecule ligands.

In another aspect, the disclosure features a population of CAR-expressing cells, e.g., CART cells. In some embodiments, the population of CAR-expressing cells comprises a mixture of cells expressing different CARs. For example, in one embodiment, the population of CART cells can include a first cell expressing a CAR having an antigen binding domain to a cancer associated antigen described herein, and a second cell expressing a CAR having a different antigen binding domain, e.g., an antigen binding domain to a different a cancer associated antigen described herein, e.g., an antigen binding domain to a cancer associated antigen described herein that differs from the cancer associate antigen bound by the antigen binding domain of the CAR expressed by the first cell. As another example, the population of CAR-expressing cells can include a first cell expressing a CAR that includes an antigen binding domain to a cancer associated antigen described herein, and a second cell expressing a CAR that includes an antigen binding domain to a target other than a cancer associate antigen as described herein. In one embodiment, the population of CAR-expressing cells includes, e.g., a first cell expressing a CAR that includes a primary intracellular signaling domain, and a second cell expressing a CAR that includes a secondary signaling domain.

In another aspect, the disclosure features a population of cells wherein at least one cell in the population expresses a CAR having an antigen binding domain to a cancer associated antigen described herein, and a second cell expressing another agent, e.g., an agent which enhances the activity of a CAR-expressing cell. For example, in one embodiment, the agent can be an agent which inhibits an inhibitory molecule. Inhibitory molecules, e.g., PD-1, can, in some embodiments, decrease the ability of a CAR-expressing cell to mount an immune effector response. Examples of inhibitory molecules include PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4 and TGFR beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4 and TGFR beta, or a fragment of any of these, and a second polypeptide which is an intracellular signaling domain described herein (e.g., comprising a costimulatory domain (e.g., 41BB, CD27, OX40 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28 signaling domain described herein and/or a CD3 zeta signaling domain described herein).

Nucleic Acid Constructs Encoding a CAR

The present invention also provides an immune effector cell, e.g., made by a method described herein, that includes a nucleic acid molecules encoding one or more CAR constructs described herein. In one aspect, the nucleic acid molecule is provided as a messenger RNA transcript. In one aspect, the nucleic acid molecule is provided as a DNA construct. The nucleic acid molecules described herein can be a DNA molecule, an RNA molecule, or a combination thereof. In other embodiments, the nucleic acid molecule is a vector that includes any of the aforesaid nucleic acid molecules.

In one aspect, the antigen binding domain of a CAR of the invention (e.g., a scFv) is encoded by a nucleic acid molecule whose sequence has been codon optimized for expression in a mammalian cell. In one aspect, entire CAR construct of the invention is encoded by a nucleic acid molecule whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

Accordingly, in one aspect, an immune effector cell, e.g., made by a method described herein, includes a nucleic acid molecule encoding a chimeric antigen receptor (CAR), wherein the CAR comprises an antigen binding domain that binds to a tumor antigen described herein, a transmembrane domain (e.g., a transmembrane domain described herein), and an intracellular signaling domain (e.g., an intracellular signaling domain described herein) comprising a stimulatory domain, e.g., a costimulatory signaling domain (e.g., a costimulatory signaling domain described herein) and/or a primary signaling domain (e.g., a primary signaling domain described herein, e.g., a zeta chain described herein).

The present invention also provides vectors in which a nucleic acid molecule encoding a CAR, e.g., a nucleic acid molecule described herein, is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (w), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR is an adenoviral vector (A5/35). In another embodiment, the expression of nucleic acids encoding CARs can be accomplished using of transposons such as sleeping beauty, crisper, CAS9, and zinc finger nucleases. See below June et al. 2009 Nature Reviews Immunology 9.10: 704-716, is incorporated herein by reference.

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription. Exemplary promoters include the CMV IE gene, EF-1α, ubiquitin C, or phosphoglycerokinase (PGK) promoters. In an embodiment, the promoter is a PGK promoter, e.g., a truncated PGK promoter as described herein.

An example of a promoter that is capable of expressing a CAR encoding nucleic acid molecule in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from nucleic acid molecules cloned into a lentiviral vector. See, e.g., Milone et al., Mol. Ther. 17(8): 1453-1464 (2009). In one aspect, the EF1a promoter comprises the sequence provided in the Examples.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

```
WT PGK Promoter:
                                        (SEQ ID NO: 357)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCGG

GTGTTCCCATCGCCGCTTCTAGGCCCACTGCGACGCTTGCCTGCACTTCT

TACACGCTCTGGGTCCCAGCCGCGGCGACGCAAAGGGCCTTGGTGCGGGT

CTCGTCGGCGCAGGGACGCGTTTGGGTCCCGACGGAACCTTTTCCGCGTT

GGGGTTGGGGCACCATAAGCT

Exemplary truncated PGK Promoters:
PGK100:
                                        (SEQ ID NO: 358)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTG

PGK200:
                                        (SEQ ID NO: 359)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACG

PGK300:
                                        (SEQ ID NO: 360)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCG

PGK400:
                                        (SEQ ID NO: 361)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCGG

GTGTTCCCATCGCCGCTTCTAGGCCCACTGCGACGCTTGCCTGCACTTCT

TACACGCTCTGGGTCCCAGCCG
```

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In embodiments, the vector may comprise two or more nucleic acid sequences encoding a CAR, e.g., a CAR described herein, e.g., a CD19 CAR, and a second CAR, e.g., an inhibitory CAR or a CAR that specifically binds to an antigen other than CD19. In such embodiments, the two or more nucleic acid sequences encoding the CAR are encoded by a single nucleic molecule in the same frame and as a single polypeptide chain. In this aspect, the two or more CARs, can, e.g., be separated by one or more peptide cleavage sites. (e.g., an auto-cleavage site or a substrate for an intracellular protease). Examples of peptide cleavage sites include T2A, P2A, E2A, or F2A sites.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A preferred method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, MO; dicetyl phosphate ("DCP") can be obtained from K & K Laboratories (Plainview, NY); cholesterol ("Choi") can be obtained from Calbiochem-Behring; dimyristyl phosphatidylglycerol ("DMPG") and other lipids may be obtained from Avanti Polar Lipids, Inc. (Birmingham, AL). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant nucleic acid sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Strategies for Regulating Chimeric Antigen Receptors

In some embodiments, a regulatable CAR (RCAR) where the CAR activity can be controlled is desirable to optimize the safety and efficacy of a CAR therapy. There are many ways CAR activities can be regulated. For example, inducible apoptosis using, e.g., a caspase fused to a dimerization domain (see, e.g., Di Stasa et al., N Egnl. J. Med. 2011 Nov. 3; 365(18):1673-1683), can be used as a safety switch in the CAR therapy of the instant invention. In one embodiment, the cells (e.g., T cells or NK cells) expressing a CAR of the present invention further comprise an inducible apoptosis switch, wherein a human caspase (e.g., caspase 9) or a modified version is fused to a modification of the human FKB protein that allows conditional dimerization. In the presence of a small molecule, such as a rapalog (e.g., AP 1903, AP20187), the inducible caspase (e.g., caspase 9) is activated and leads to the rapid apoptosis and death of the cells (e.g., T cells or NK cells) expressing a CAR of the present invention. Examples of a caspase-based inducible apoptosis switch (or one or more aspects of such a switch) have been described in, e.g., US2004040047; US20110286980; US20140255360; WO1997031899; WO2014151960; WO2014164348; WO2014197638; WO2014197638; all of which are incorporated by reference herein.

In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. Cancer Gene Ther. 2008; 15(10):667-75; Clinical Trial Id. No. NCT02107963; and Di Stasi et al. N. Engl. J. Med. 2011; 365:1673-83.

Alternative strategies for regulating the CAR therapy of the instant invention include utilizing small molecules or antibodies that deactivate or turn off CAR activity, e.g., by deleting CAR-expressing cells, e.g., by inducing antibody dependent cell-mediated cytotoxicity (ADCC). For example, CAR-expressing cells described herein may also express an antigen that is recognized by molecules capable of inducing cell death, e.g., ADCC or complement-induced cell death. For example, CAR expressing cells described herein may also express a receptor capable of being targeted by an antibody or antibody fragment. Examples of such receptors include EpCAM, VEGFR, integrins (e.g., integrins αvβ3, α4, αI¾β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

For example, a CAR-expressing cell described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., Gene Ther. 2013; 20(8) 853-860). Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., Blood. 2014; 124(8)1277-1287). Other methods for depleting CAR-expressing cells described herein include administration of CAMPATH, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g., ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In other embodiments, a CAR-expressing cell described herein may also express a target protein recognized by the T cell depleting agent. In one embodiment, the target protein is CD20 and the T cell depleting agent is an anti-CD20 antibody, e.g., rituximab. In such embodiment, the T cell depleting agent is administered once it is desirable to reduce or eliminate the CAR-expressing cell, e.g., to mitigate the CAR induced toxicity. In other embodiments, the T cell depleting agent is an anti-CD52 antibody, e.g., alemtuzumab.

In an aspect, a RCAR comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. In one embodiment, a CAR of the present invention utilizes a dimerization switch as those described in, e.g., WO2014127261, which is incorporated by reference herein. Additional description and exemplary configurations of such regulatable CARs are provided herein and in, e.g., paragraphs 527-551 of International Publication No. WO 2015/090229 filed Mar. 13, 2015, which is incorporated by reference in its entirety.

Dimerization Switches

Dimerization switches can be non-covalent or covalent. In a non-covalent dimerization switch, the dimerization molecule promotes a non-covalent interaction between the switch domains. In a covalent dimerization switch, the dimerization molecule promotes a covalent interaction between the switch domains.

In an embodiment, the RCAR comprises a FKBP/FRAP, or FKBP/FRB-based dimerization switch. FKBP12 (FKBP, or FK506 binding protein) is an abundant cytoplasmic protein that serves as the initial intracellular target for the natural product immunosuppressive drug, rapamycin. Rapamycin binds to FKBP and to the large PI3K homolog FRAP (RAFT, mTOR). FRB is a 93 amino acid portion of FRAP, that is sufficient for binding the FKBP-rapamycin complex (Chen, J., Zheng, X. F., Brown, E. J. & Schreiber, S. L. (1995) *Identification of an 11-kDa FKBP12-rapamycin-binding domain within the 289-kDa FKBP12-rapamycin-associated protein and characterization of a critical serine residue*. Proc Natl Acad Sci USA 92: 4947-51.)

In embodiments, an FKBP/FRAP, e.g., an FKBP/FRB, based switch can use a dimerization molecule, e.g., rapamycin or a rapamycin analog.

The amino acid sequence of FKBP is as follows:

```
                                        (SEQ ID NO: 131)
    D V P D Y A S L G G P S S P K K K R K V S R

G V Q V E T I S P G D G R T F P K R G Q T C V V H

Y T G M L E D G K K F D S S R D R N K P F K F M L

G K Q E V I R G W E E G V A Q M S V G Q R A K L T

I S P D Y A Y G A T G H P G I I P P H A T L V F D

V E L L K L E T S Y
```

In embodiments, an FKBP switch domain can comprise a fragment of FKBP having the ability to bind with FRB, or a fragment or analog thereof, in the presence of rapamycin or a rapalog, e.g., the underlined portion of SEQ ID NO: 131, which is:

```
                                            (SEQ ID NO: 132)
    V Q V E T I S P G D G R T F P K R G Q T C V

V H Y T G M L E D G K K F D S S R D R N K P F K F

M L G K Q E V I R G W E E G V A Q M S V G Q R A K

L T I S P D Y A Y G A T G H P G I I P P H A T L V

F D V E L L K L E T S
```

The amino acid sequence of FRB is as follows:

```
                                            (SEQ ID NO: 133)
    ILWHEMWHEG LEEASRLYFG ERNVKGMFEV LEPLHAMMER

GPQTLKETSF NQAYGRDLME AQEWCRKYMK SGNVKDLTQA

WDLYYHVFRR ISK
```

"FKBP/FRAP, e.g., an FKBP/FRB, based switch" as that term is used herein, refers to a dimerization switch comprising: a first switch domain, which comprises an FKBP fragment or analog thereof having the ability to bind with FRB, or a fragment or analog thereof, in the presence of rapamycin or a rapalog, e.g., RAD001, and has at least 70, 75, 80, 85, 90, 95, 96, 97, 98, or 99% identity with, or differs by no more than 30, 25, 20, 15, 10, 5, 4, 3, 2, or 1 amino acid residues from, the FKBP sequence of SEQ ID NO: 131 or 132; and a second switch domain, which comprises an FRB fragment or analog thereof having the ability to bind with FRB, or a fragment or analog thereof, in the presence of rapamycin or a rapalog, and has at least 70, 75, 80, 85, 90, 95, 96, 97, 98, or 99% identity with, or differs by no more than 30, 25, 20, 15, 10, 5, 4, 3, 2, or 1 amino acid residues from, the FRB sequence of SEQ ID NO: 133. In an embodiment, a RCAR described herein comprises one switch domain comprises amino acid residues disclosed in SEQ ID NO: 131 (or SEQ ID NO: 132), and one switch domain comprises amino acid residues disclosed in SEQ ID NO: 133.

In embodiments, the FKBP/FRB dimerization switch comprises a modified FRB switch domain that exhibits altered, e.g., enhanced, complex formation between an FRB-based switch domain, e.g., the modified FRB switch domain, a FKBP-based switch domain, and the dimerization molecule, e.g., rapamycin or a rapalogue, e.g., RAD001. In an embodiment, the modified FRB switch domain comprises one or more mutations, e.g., 2, 3, 4, 5, 6, 7, 8, 9, 10 or more, selected from mutations at amino acid position(s) L2031, E2032, S2035, R2036, F2039, G2040, T2098, W2101, D2102, Y2105, and F2108, where the wild-type amino acid is mutated to any other naturally-occurring amino acid. In an embodiment, a mutant FRB comprises a mutation at E2032, where E2032 is mutated to phenylalanine (E2032F), methionine (E2032M), arginine (E2032R), valine (E2032V), tyrosine (E2032Y), isoleucine (E2032I), e.g., SEQ ID NO: 134, or leucine (E2032L), e.g., SEQ ID NO: 135. In an embodiment, a mutant FRB comprises a mutation at T2098, where T2098 is mutated to phenylalanine (T2098F) or leucine (T2098L), e.g., SEQ ID NO: 136. In an embodiment, a mutant FRB comprises a mutation at E2032 and at T2098, where E2032 is mutated to any amino acid, and where T2098 is mutated to any amino acid, e.g., SEQ ID NO: 137. In an embodiment, a mutant FRB comprises an E2032I and a T2098L mutation, e.g., SEQ ID NO: 138. In an embodiment, a mutant FRB comprises an E2032L and a T2098L mutation, e.g., SEQ ID NO: 139.

TABLE 10

Exemplary mutant FRB having increased affinity for a dimerization molecule.

| FRB mutant | Amino Acid Sequence | SEQ ID NO: |
|---|---|---|
| E2032I mutant | ILWHEMWHEGLIEASRLYFGERNVKGMFEVLEPLHAMMERGPQTLKETSFNQ AYGRDLMEAQEWCRKYMKSGNVKDLTQAWDLYYHVFRRISKTS | 134 |
| E2032L mutant | ILWHEMWHEGLLEASRLYFGERNVKGMFEVLEPLHAMMERGPQTLKETSFNQ AYGRDLMEAQEWCRKYMKSGNVKDLTQAWDLYYHVFRRISKTS | 135 |
| T2098L mutant | ILWHEMWHEGLEEASRLYFGERNVKGMFEVLEPLHAMMERGPQTLKETSFNQ AYGRDLMEAQEWCRKYMKSGNVKDLLQAWDLYYHVFRRISKTS | 136 |
| E2032, T2098 mutant | ILWHEMWHEGL<u>X</u>EASRLYFGERNVKGMFEVLEPLHAMMERGPQTLKETSFNQ AYGRDLMEAQEWCRKYMKSGNVKDL<u>X</u>QAWDLYYHVFRRISKTS | 137 |
| E2032I, T2098L mutant | ILWHEMWHEGLIEASRLYFGERNVKGMFEVLEPLHAMMERGPQTLKETSFNQ AYGRDLMEAQEWCRKYMKSGNVKDLLQAWDLYYHVFRRISKTS | 138 |
| E2032L, T2098L mutant | ILWHEMWHEGLLEASRLYFGERNVKGMFEVLEPLHAMMERGPQTLKETSFNQ AYGRDLMEAQEWCRKYMKSGNVKDLLQAWDLYYHVFRRISKTS | 139 |

Natural Killer Cell Receptor (NKR) CARs

In an embodiment, the CAR molecule described herein comprises one or more components of a natural killer cell receptor (NKR), thereby forming an NKR-CAR. The NKR component can be a transmembrane domain, a hinge domain, or a cytoplasmic domain from any of the following natural killer cell receptors: killer cell immunoglobulin-like receptor (KIR), e.g., KIR2DL1, KIR2DL2/L3, KIR2DL4, KIR2DL5A, KIR2DL5B, K1R2DS1, KIR2DS2, KIR2DS3, KIR2DS4, DIR2DS5, KIR3DL1/S1, KIR3DL2, KIR3DL3, KIR2DP1, and KIR3DP1; natural cytotoxicity receptor (NCR), e.g., NKp30, NKp44, NKp46; signaling lymphocyte activation molecule (SLAM) family of immune cell receptors, e.g., CD48, CD229, 2B4, CD84, NTB-A, CRACC, BLAME, and CD2F-10; Fc receptor (FcR), e.g., CD16, and CD64; and Ly49 receptors, e.g., LY49A, LY49C. The NKR-CAR molecules described herein may interact with an adaptor molecule or intracellular signaling domain, e.g., DAP12. Exemplary configurations and sequences of CAR molecules comprising NKR components are described in International Publication No. WO2014/145252, the contents of which are hereby incorporated by reference.

Split CAR

In some embodiments, the CAR-expressing cell uses a split CAR. The split CAR approach is described in more detail in publications WO2014/055442 and WO2014/055657. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

Immune Effector Cells

Also described herein are cells which contain a CAR molecule described herein or a nucleic acid encoding a CAR as described herein. Also described herein are cells which have been transfected or transformed with a nucleic acid described herein, e.g., a nucleic acid encoding a CAR, e.g., as described herein. In one embodiment, the cell is a cell described herein, e.g., a human T cell, e.g., a human T cell described herein, or a human NK cell, e.g., a human NK cell described herein. In one embodiment, the human T cell is a CD8+ T cell. In some embodiments, the cell is autologous to the subject to be treated with the cell. In some embodiments, the cell is allogeneic to the subject to be treated with the cell.

In one aspect, the CAR-expressing cell described herein can further comprise a second CAR, e.g., a second CAR that includes a different antigen binding domain, e.g., to the same target or a different target (e.g., a target other than a tumor antigen described herein or a different tumor antigen described herein). In one embodiment, the second CAR includes an antigen binding domain to a target expressed the same cancer cell type as the tumor antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, ICOS, CD27 or OX-40, onto the first CAR, and the primary signaling domain, e.g., CD3 zeta, on the second CAR can limit the CAR activity to cells where both targets are expressed. In one embodiment, the CAR expressing cell comprises a first tumor antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In another aspect, the present invention provides a population of CAR-expressing cells, e.g., at least one or more of which comprises a nucleic acid molecule described herein. In some embodiments, the population of CAR-expressing cells comprises a mixture of cells expressing different CARs.

For example, in one embodiment, the population of CART cells can include a first cell expressing a CAR having an antigen binding domain to a tumor antigen described herein, and a second cell expressing a CAR having a different antigen binding domain, e.g., an antigen binding domain to a different tumor antigen described herein, e.g., an antigen binding domain to a tumor antigen described herein that differs from the tumor antigen bound by the antigen binding domain of the CAR expressed by the first cell.

As another example, the population of CAR-expressing cells can include a first cell expressing a CAR that includes an antigen binding domain to a tumor antigen described herein, and a second cell expressing a CAR that includes an antigen binding domain to a target other than a tumor antigen as described herein. In one embodiment, the population of CAR-expressing cells includes, e.g., a first cell expressing a CAR that includes a primary intracellular signaling domain, and a second cell expressing a CAR that includes a secondary signaling domain.

In another aspect, the present invention provides a population of cells wherein at least one cell in the population expresses a CAR having an antigen binding domain to a tumor antigen described herein, and a second cell expressing another agent, e.g., an agent which enhances the activity of a CAR-expressing cell. In one embodiment, the agent can be an agent which inhibits an inhibitory molecule. Inhibitory molecules, e.g., PD-1, can, in some embodiments, decrease the ability of a CAR-expressing cell to mount an immune effector response. Examples of inhibitory molecules include PD-1, PD-L1, PD-L2, CTLA4, TIM3, CEACAM (CEACAM-1, CEACAM-3, and/or CEACAM-5), LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR (e.g., TGFRbeta). In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3, and/or CEACAM-5), LAG3, VISTA, BTLA, TIGIT, LAIR1, CD160, 2B4 or TGFR beta, or a fragment of any of these, and a second polypeptide which is an intracellular signaling domain described herein (e.g., comprising a costimulatory domain (e.g., 41BB, CD27, OX40 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28 signaling domain described herein and/or a CD3 zeta signaling domain described herein).

RNA Transfection

Disclosed herein are methods for producing an in vitro transcribed RNA CAR. The methods described herein can include introducing a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (e.g., SEQ ID NO:35). RNA so produced can efficiently transfect different kinds of cells. In one aspect, the template includes sequences for the CAR.

An immune effector cell can include a CAR encoded by a messenger RNA (mRNA). In one aspect, the mRNA encoding a CAR described herein is introduced into an immune effector cell, e.g., made by a method described herein, for production of a CAR-expressing cell.

In one embodiment, the in vitro transcribed RNA CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired temple for in vitro transcription is a CAR described herein. For example, the template for the RNA CAR comprises an extracellular region comprising a single chain variable domain of an antibody to a tumor associated antigen described herein; a hinge region (e.g., a hinge region described herein), a transmembrane domain (e.g., a transmembrane domain described herein such as a transmembrane domain of CD8a); and a cytoplasmic region that includes an intracellular signaling domain, e.g., an intracellular signaling domain described herein, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 31) (size can be 50-5000 T (SEQ ID NO: 32)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (e.g., SEQ ID NO: 30).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides (SEQ ID NO: 34) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013): 166; Williams. Molecular Therapy 16.9(2008):1515-16; Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Activation and Expansion of Immune Effector Cells (e.g., T Cells)

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

Generally, a population of immune effector cells, e.g., T regulatory cell depleted cells, may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besancon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In one aspect, more anti-CD28 antibody is bound to the particles than anti-CD3 antibody, i.e., the ratio of CD3:CD28 is less than one. In certain aspects, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle:cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a CAR, e.g., a CAR described herein, e.g., a CD19 CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CD19 CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CD19 CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CD19 CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence IL-15 and/or IL-7 (e.g., IL-15 and IL-7).

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a CAR described herein is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a cars of the present invention are described in further detail below Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of $CD4^+$ and $CD8^+$ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of $CAR^+$ T cells following antigen stimulation can be measured by flow cytometry. For example, a mixture of $CD4^+$ and $CD8^+$ T cells are stimulated with aCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the $CD4^+$ and/or $CD8^+$ T cell subsets by flow cytometry. See, e.g., Milone et al., Molecular Therapy 17(8): 1453-1464 (2009). Alternatively, a mixture of $CD4^+$ and $CD8^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either a cancer associated antigen as described herein$^+$ K562 cells (K562-expressing a cancer associated antigen as described herein), wild-type K562 cells (K562 wild type) or K562 cells expressing hCD32 and 4-1BBL in the presence of antiCD3 and anti-CD28 antibody (K562-BBL-3/28) following washing. Exogenous IL-2 is added to the cultures every other day at 100 IU/ml. $GFP^+$ T cells are enumerated by flow cytometry using bead-based counting. See, e.g., Milone et al., Molecular Therapy 17(8): 1453-1464 (2009).

Sustained $CAR^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter following stimulation with αCD3/αCD28 coated magnetic beads on day 0, and transduction with the indicated CAR on day 1.

Animal models can also be used to measure a a CAR-expressing cell activity, e.g., as described in paragraph 698 of International Application WO2015/142675, filed Mar. 13, 2015, which is herein incorporated by reference in its entirety. Dose dependent CAR treatment response can be evaluated, e.g., as described in paragraph 699 of International Application WO2015/142675, filed Mar. 13, 2015, which is herein incorporated by reference in its entirety. Assessment of cell proliferation and cytokine production has been previously described, e.g., as described in paragraph 700 of International Application WO2015/142675, filed Mar. 13, 2015, which is herein incorporated by reference in its entirety. Cytotoxicity can be assessed by a standard 51Cr-release assay, e.g., as described in paragraph 701 of International Application WO2015/142675, filed Mar. 13, 2015, which is herein incorporated by reference in its entirety. Imaging technologies can be used to evaluate specific trafficking and proliferation of CARs in tumor-bearing animal models, e.g., as described in paragraph 702 of International Application WO2015/142675, filed Mar. 13, 2015, which is herein incorporated by reference in its entirety. Other assays, including those described in the Example section herein as well as those that are known in the art can also be used to evaluate the CARs described herein.

Alternatively, or in combination to the methods disclosed herein, methods and compositions for one or more of: detection and/or quantification of CAR-expressing cells (e.g., in vitro or in vivo (e.g., clinical monitoring)); immune cell expansion and/or activation; and/or CAR-specific selection, that involve the use of a CAR ligand, are disclosed. In one exemplary embodiment, the CAR ligand is an antibody that binds to the CAR molecule, e.g., binds to the extracellular antigen binding domain of CAR (e.g., an antibody that binds to the antigen binding domain, e.g., an anti-idiotypic antibody; or an antibody that binds to a constant region of the extracellular binding domain). In other embodiments, the CAR ligand is a CAR antigen molecule (e.g., a CAR antigen molecule as described herein).

In one aspect, a method for detecting and/or quantifying CAR-expressing cells is disclosed. For example, the CAR ligand can be used to detect and/or quantify CAR-expressing cells in vitro or in vivo (e.g., clinical monitoring of CAR-expressing cells in a patient, or dosing a patient). The method includes:

providing the CAR ligand (optionally, a labelled CAR ligand, e.g., a CAR ligand that includes a tag, a bead, a radioactive or fluorescent label);

acquiring the CAR-expressing cell (e.g., acquiring a sample containing CAR-expressing cells, such as a manufacturing sample or a clinical sample);

contacting the CAR-expressing cell with the CAR ligand under conditions where binding occurs, thereby detecting the level (e.g., amount) of the CAR-expressing cells present. Binding of the CAR-expressing cell with the CAR ligand can be detected using standard techniques such as FACS, ELISA and the like.

In another aspect, a method of expanding and/or activating cells (e.g., immune effector cells) is disclosed. The method includes:

providing a CAR-expressing cell (e.g., a first CAR-expressing cell or a transiently expressing CAR cell);

contacting said CAR-expressing cell with a CAR ligand, e.g., a CAR ligand as described herein), under conditions where immune cell expansion and/or proliferation occurs, thereby producing the activated and/or expanded cell population.

In certain embodiments, the CAR ligand is present on a substrate (e.g., is immobilized or attached to a substrate, e.g., a non-naturally occurring substrate). In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the CAR ligand is present in the substrate (e.g., on the substrate surface). The CAR ligand can be immobilized, attached, or associated covalently or non-covalently (e.g., cross-linked) to the substrate. In one embodiment, the CAR ligand is attached (e.g., covalently attached) to a bead. In the aforesaid embodiments, the immune cell population can be expanded in vitro or ex vivo. The method can further include culturing the population of immune cells in the presence of the ligand of the CAR molecule, e.g., using any of the methods described herein.

In other embodiments, the method of expanding and/or activating the cells further comprises addition of a second stimulatory molecule, e.g., CD28. For example, the CAR ligand and the second stimulatory molecule can be immobilized to a substrate, e.g., one or more beads, thereby providing increased cell expansion and/or activation.

In yet another aspect, a method for selecting or enriching for a CAR expressing cell is provided. The method includes contacting the CAR expressing cell with a CAR ligand as described herein; and selecting the cell on the basis of binding of the CAR ligand.

In yet other embodiments, a method for depleting, reducing and/or killing a CAR expressing cell is provided. The method includes contacting the CAR expressing cell with a CAR ligand as described herein; and targeting the cell on the basis of binding of the CAR ligand, thereby reducing the number, and/or killing, the CAR-expressing cell. In one embodiment, the CAR ligand is coupled to a toxic agent (e.g., a toxin or a cell ablative drug). In another embodiment, the anti-idiotypic antibody can cause effector cell activity, e.g., ADCC or ADC activities.

Exemplary anti-CAR antibodies that can be used in the methods disclosed herein are described, e.g., in WO 2014/190273 and by Jena et al., "Chimeric Antigen Receptor (CAR)-Specific Monoclonal Antibody to Detect CD19-Specific T cells in Clinical Trials", PLOS March 2013 8:3 e57838, the contents of which are incorporated by reference.

In some aspects and embodiments, the compositions and methods herein are optimized for a specific subset of T cells, e.g., as described in WO 2016/019300, the contents of which are incorporated herein by reference in their entirety. In some embodiments, the optimized subsets of T cells display an enhanced persistence compared to a control T cell, e.g., a T cell of a different type (e.g., CD8+ or CD4+) expressing the same construct.

In some embodiments, a CD4+ T cell comprises a CAR described herein, which CAR comprises an intracellular signaling domain suitable for (e.g., optimized for, e.g., leading to enhanced persistence in) a CD4+ T cell, e.g., an ICOS domain. In some embodiments, a CD8+ T cell comprises a CAR described herein, which CAR comprises an intracellular signaling domain suitable for (e.g., optimized for, e.g., leading to enhanced persistence of) a CD8+ T cell, e.g., a 4-1BB domain, a CD28 domain, or another costimulatory domain other than an ICOS domain. In some embodiments, the CAR described herein comprises an antigen binding domain described herein, e.g., a CAR comprising an antigen binding domain.

In an aspect, described herein is a method of treating a subject, e.g., a subject having cancer. The method includes administering to said subject, an effective amount of:
1) a CD4+ T cell comprising a CAR (the CARCD4+) comprising:
   an antigen binding domain, e.g., an antigen binding domain described herein;
   a transmembrane domain; and
   an intracellular signaling domain, e.g., a first costimulatory domain, e.g., an ICOS domain; and
2) a CD8+ T cell comprising a CAR (the CARCD8+) comprising:
   an antigen binding domain, e.g., an antigen binding domain described herein;
   a transmembrane domain; and
   an intracellular signaling domain, e.g., a second co stimulatory domain, e.g., a 4-1BB domain, a CD28 domain, or another costimulatory domain other than an ICOS domain;
   wherein the CARCD4+ and the CARCD8+ differ from one another.

Optionally, the method further includes administering:
3) a second CD8+ T cell comprising a CAR (the second CARCD8+) comprising:
   an antigen binding domain, e.g., an antigen binding domain described herein;
   a transmembrane domain; and
   an intracellular signaling domain, wherein the second CARCD8+ comprises an intracellular signaling domain, e.g., a costimulatory signaling domain, not present on the CARCD8+, and, optionally, does not comprise an ICOS signaling domain.

Any of the methods described herein can further include administration of a BTK inhibitor as described herein.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic. Accordingly, in some embodiments, the manufacturing methods herein include a step of contacting the CAR-expressing cells with a biopolymer, e.g. a biopolymer of this section.

Examples of suitable biopolymers include, but are not limited to, agar, agarose, alginate, alginate/calcium phosphate cement (CPC), beta-galactosidase (β-GAL), (1,2,3,4,6-pentaacetyl a-D-galactose), cellulose, chitin, chitosan, collagen, elastin, gelatin, hyaluronic acid collagen, hydroxyapatite, poly(3-hydroxybutyrate-co-3-hydroxyhexanoate) (PHBHHx), poly(lactide), poly(caprolactone) (PCL), poly(lactide-co-glycolide) (PLG), polyethylene oxide (PEO), poly(lactic-co-glycolic acid) (PLGA), polypropylene oxide (PPO), polyvinyl alcohol) (PVA), silk, soy protein, and soy protein isolate, alone or in combination with any other polymer composition, in any concentration and in any ratio. The biopolymer can be augmented or modified with adhesion- or migration-promoting molecules, e.g., collagen-mimetic peptides that bind to the collagen receptor of lymphocytes, and/or stimulatory molecules to enhance the delivery, expansion, or function, e.g., anti-cancer activity, of the cells to be delivered. The biopolymer scaffold can be an injectable, e.g., a gel or a semi-solid, or a solid composition.

In some embodiments, CAR-expressing cells described herein are seeded onto the biopolymer scaffold prior to delivery to the subject. In embodiments, the biopolymer scaffold further comprises one or more additional therapeutic agents described herein (e.g., another CAR-expressing cell, an antibody, or a small molecule) or agents that enhance the activity of a CAR-expressing cell, e.g., incorporated or conjugated to the biopolymers of the scaffold. In embodiments, the biopolymer scaffold is injected, e.g., intratumorally, or surgically implanted at the tumor or within a proximity of the tumor sufficient to mediate an anti-tumor effect. Additional examples of biopolymer compositions and methods for their delivery are described in Stephan et al., *Nature Biotechnology*, 2015, 33:97-101; and WO2014/110591.

Methods of Manufacture/Production

In some embodiments, the methods disclosed herein further include administering a T cell depleting agent after treatment with the cell (e.g., an immune effector cell as described herein, e.g., an immune effector cell expressing CAR described herein), thereby reducing (e.g., depleting) the CAR-expressing cells (e.g., the CD19CAR-expressing cells). Such T cell depleting agents can be used to effectively deplete CAR-expressing cells (e.g., CD19CAR-expressing cells) to mitigate toxicity. In some embodiments, the CAR-expressing cells were manufactured according to a method herein, e.g., assayed (e.g., before or after transfection or transduction) according to a method herein.

In some embodiments, the T cell depleting agent is administered one, two, three, four, or five weeks after administration of the cell, e.g., the population of immune effector cells, described herein.

In one embodiment, the T cell depleting agent is an agent that depletes CAR-expressing cells, e.g., by inducing antibody dependent cell-mediated cytotoxicity (ADCC) and/or complement-induced cell death. For example, CAR-expressing cells described herein may also express an antigen (e.g., a target antigen) that is recognized by molecules capable of inducing cell death, e.g., ADCC or complement-induced cell death. For example, CAR expressing cells described herein may also express a target protein (e.g., a receptor) capable of being targeted by an antibody or antibody fragment. Examples of such target proteins include, but are not limited to, EpCAM, VEGFR, integrins (e.g., integrins $\alpha v\beta 3$, $\alpha 4$, $\alpha I3/4\beta 3$, $\alpha 4\beta 7$, $\alpha 5\beta 1$, $\alpha v\beta 3$, $\alpha v$), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

In some embodiments, the CAR expressing cell co-expresses the CAR and the target protein, e.g., naturally expresses the target protein or is engineered to express the target protein. For example, the cell, e.g., the population of immune effector cells, can include a nucleic acid (e.g., vector) comprising the CAR nucleic acid (e.g., a CAR nucleic acid as described herein) and a nucleic acid encoding the target protein.

In one embodiment, the T cell depleting agent is a CD52 inhibitor, e.g., an anti-CD52 antibody molecule, e.g., alemtuzumab.

In other embodiments, the cell, e.g., the population of immune effector cells, expresses a CAR molecule as described herein (e.g., CD19CAR) and the target protein recognized by the T cell depleting agent. In one embodiment, the target protein is CD20. In embodiments where the target protein is CD20, the T cell depleting agent is an anti-CD20 antibody, e.g., rituximab.

In further embodiments of any of the aforesaid methods, the methods further include transplanting a cell, e.g., a hematopoietic stem cell, or a bone marrow, into the mammal. In another aspect, the invention features a method of conditioning a mammal prior to cell transplantation. The method includes administering to the mammal an effective amount of the cell comprising a CAR nucleic acid or polypeptide, e.g., a CD19 CAR nucleic acid or polypeptide. In some embodiments, the cell transplantation is a stem cell transplantation, e.g., a hematopoietic stem cell transplantation, or a bone marrow transplantation. In other embodiments, conditioning a subject prior to cell transplantation includes reducing the number of target-expressing cells in a subject, e.g., CD19-expressing normal cells or CD19-expressing cancer cells.

Pharmaceutical Compositions and Treatments

The methods described herein can further include formulating a CAR-expressing cell in a pharmaceutical composition. Pharmaceutical compositions may comprise a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions can be formulated, e.g., for intravenous administration.

In one embodiment, the pharmaceutical composition is substantially free of, e.g., there are no detectable levels of a contaminant, e.g., selected from the group consisting of endotoxin, mycoplasma, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-cancer effective amount," "a cancer-inhibiting effective amount," or "therapeutic amount" is indicated, the precise amount of the compositions to be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In some embodiments, a dose of CAR cells comprises about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises at least about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises up to about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises about $1.1\times10^6$-$1.8\times10^7$ cells/kg. In some embodiments, a dose of CAR cells (e.g., CD19 CAR cells) comprises about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD19 CAR cells) comprises at least about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD19 CAR cells) comprises up to about $1\times10^7$, $2\times10^7$, $5\times10^7$, $1\times10^8$, $2\times10^8$, $5\times10^8$, $1\times10^9$, $2\times10^9$, or $5\times10^9$ cells.

The dosage of the treatments to be administered to a patient will vary with the precise nature of the condition being treated and the recipient of the treatment. The scaling of dosages for human administration can be performed according to art-accepted practices. The dose for CAMPATH, for example, will generally be in the range 1 to about 100 mg for an adult patient, usually administered daily for a period between 1 and 30 days. The suitable daily dose is 1 to 10 mg per day although in some instances larger doses of up to 40 mg per day may be used (described in U.S. Pat. No. 6,120,766).

In certain aspects, it may be desired to administer activated immune effector cells (e.g., T cells, NK cells) to a subject and then subsequently redraw blood (or have an apheresis performed), activate immune effector cells (e.g., T cells, NK cells) therefrom, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

The administration of the subject compositions may be carried out in any convenient manner. The compositions described herein may be administered to a patient transarterially, subcutaneously, intradermally, intratumorally, intranodally, intramedullary, intramuscularly, by intravenous (i.v.) injection, or intraperitoneally, e.g., by intradermal or subcutaneous injection. The compositions of immune effector cells (e.g., T cells, NK cells) may be injected directly into a tumor, lymph node, or site of infection.

Immune effector cells manufactured according to the methods herein can be administered to a subject in combination with a molecule that decreases the $T_{REG}$ cell population. Methods that decrease the number of (e.g., deplete) $T_{REG}$ cells are known in the art and include, e.g., CD25 depletion, cyclophosphamide administration, and modulating GITR function. Without wishing to be bound by theory, it is believed that reducing the number of $T_{REG}$ cells in a subject prior to apheresis or prior to administration of a CAR-expressing cell described herein reduces the number of unwanted immune cells (e.g., Tregs) in the tumor microenvironment and reduces the subject's risk of relapse. In one embodiment, cells expressing a CAR described herein are administered to a subject in combination with a molecule targeting GITR and/or modulating GITR functions, such as a GITR agonist and/or a GITR antibody that depletes regulatory T cells ($T_{REG}$s). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to administration of the CAR-expressing cell. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to aphersis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In an embodiment, the subject has CLL. In embodiments, the subject has ALL. In embodiments, the subject has a solid cancer, e.g., a solid cancer described herein. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In an embodiment, cells expressing a CAR described herein are administered to a subject in combination with a molecule that decreases the Treg cell population. Methods that decrease the number of (e.g., deplete) Treg cells are known in the art and include, e.g., CD25 depletion, cyclophosphamide administration, modulating GITR function. Without wishing to be bound by theory, it is believed that reducing the number of Treg cells in a subject prior to apheresis or prior to administration of a CAR-expressing cell described herein reduces the number of unwanted immune cells (e.g., Tregs) in the tumor microenvironment and reduces the subject's risk of relapse.

In one embodiment, a therapy described herein, e.g., a CAR-expressing cell, is administered to a subject in combination with a molecule targeting GITR and/or modulating GITR functions, such as a GITR agonist and/or a GITR antibody that depletes regulatory T cells (Tregs). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to the CAR-expressing cell. For example, in one embodiment, a GITR agonist can be administered prior to apheresis of the cells. In embodiments, cyclophosphamide is administered to the subject prior to administration (e.g., infusion or re-infusion) of the CAR-expressing cell or prior to apheresis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In one embodiment, the subject has CLL. In embodiments, the subject has ALL. In embodiments, the subject has a solid cancer, e.g., a solid cancer described herein.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells. In one embodiment, the subject has CLL.

Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein, in combination with a BTK inhibitor described herein, is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells. In one embodiment, the subject has CLL.

Exemplary CAR Constructs

The sequences of anti-CD19 binding domains are provided above in Table 1. The sequences of anti-BCMA binding domains are provided in Table 11. Full CAR constructs can be generated using any of the antigen binding domains described in Table 1 or Table 11 with one or more additional CAR component provided below.

```
leader (amino acid sequence)
                                                        (SEQ ID NO: 1)
MALPVTALLLPLALLLHAARP leader (nucleic acid sequence)
                                                        (SEQ ID NO: 12)
ATGGCCCTGCCTGTGACAGCCCTGCTGCTGCCTCTGGCTCTGCTGCTGCATGCCGCTAGACC

C

CD8 hinge (amino acid sequence)
                                                        (SEQ ID NO: 2)
TTTPAPRPPTPAPTIASQPLSLRPEACRPAAGGAVHTRGLDFACD CD8 hinge (nucleic acid sequence)
                                                        (SEQ ID NO: 13)
ACCACGACGCCAGCGCCGCGACCACCAACACCGGCGCCCACCATCGCGTCGCAGCCCCTG

TCCCTGCGCCCAGAGGCGTGCCGGCCAGCGGCGGGGGGCGCAGTGCACACGAGGGGGCTG

GACTTCGCCTGTGAT

CD8 transmembrane (amino acid sequence)
                                                        (SEQ ID NO: 6)
IYIWAPLAGTCGVLLLSLVITLYC transmembrane (nucleic acid sequence)
                                                        (SEQ ID NO: 17)
ATCTACATCTGGGCGCCCTTGGCCGGGACTTGTGGGGTCCTTCTCCTGTCACTGGTTATCAC

CCTTTACTGC 4-1BB Intracellular domain (amino acid sequence)
                                                        (SEQ ID NO: 7)
KRGRKKLLYIFKQPFMRPVQTTQEEDGCSCRFPEEEEGGCEL 4-1BB Intracellular domain (nucleic acid sequence)
                                                        (SEQ ID NO: 18)
AAACGGGGCAGAAAGAAACTCCTGTATATATTCAAACAACCATTTATGAGACCAGTACAA

ACTACTCAAGAGGAAGATGGCTGTAGCTGCCGATTTCCAGAAGAAGAAGAAGGAGGATGT

GAACTG
```

```
ICOS Intracellular domain (amino acid sequence)
                                                    (SEQ ID NO: 364)
TKKKYSSSVHDPNGEYMFMRAVNTAKKSRLTDVTL ICOS Intracellular domain (nucleic acid sequence)
                                                    (SEQ ID NO: 365)
ACAAAAAGAAGTATTCATCCAGTGTGCACGACCCTAACGGTGAATACATGTTCATGAGA

GCAGTGAACACAGCCAAAAAATCCAGACTCACAGATGTGACCCTA

CD3 zeta domain (amino acid sequence)
                                                    (SEQ ID NO: 9)
RVKFSRSADAPAYKQGQNQLYNELNLGRREEYDVLDKRRGRDPEMGGKPRRKNPQEGLYNE

LQKDKMAEAYSEIGMKGERRRGKGHDGLYQGLSTATKDTYDALHMQALPPR

CD3 zeta (nucleic acid sequence)
                                                    (SEQ ID NO: 20)
AGAGTGAAGTTCAGCAGGAGCGCAGACGCCCCCGCGTACAAGCAGGGCCAGAACCAGCTC

TATAACGAGCTCAATCTAGGACGAAGAGAGGAGTACGATGTTTTGGACAAGAGACGTGGC

CGGGACCCTGAGATGGGGGGAAAGCCGAGAAGGAAGAACCCTCAGGAAGGCCTGTACAA

TGAACTGCAGAAAGATAAGATGGCGGAGGCCTACAGTGAGATTGGGATGAAAGGCGAGCG

CCGGAGGGGCAAGGGGCACGATGGCCTTTACCAGGGTCTCAGTACAGCCACCAAGGACAC

CTACGACGCCCTTCACATGCAGGCCCTGCCCCCTCGC

CD3 zeta domain (amino acid sequence; NCBI Reference
Sequence NM_000734.3)
                                                    (SEQ ID NO: 10)
RVKFSRSADAPAYQQGQNQLYNELNLGRREEYDVLDKRRGRDPEMGGKPRRKNPQEGLYNE

LQKDKMAEAYSEIGMKGERRRGKGHDGLYQGLSTATKDTYDALHMQALPPR

CD3 zeta (nucleic acid sequence; NCBI Reference Sequence
NM_000734.3);
                                                    (SEQ ID NO: 21)
AGAGTGAAGTTCAGCAGGAGCGCAGACGCCCCCGCGTACCAGCAGGGCCAG

AACCAGCTCTATAACGAGCTCAATCTAGGACGAAGAGAGGAGTACGATGTTT

TGGACAAGAGACGTGGCCGGGACCCTGAGATGGGGGGAAAGCCGAGAAGGA

AGAACCCTCAGGAAGGCCTGTACAATGAACTGCAGAAAGATAAGATGGCGG

AGGCCTACAGTGAGATTGGGATGAAAGGCGAGCGCCGGAGGGGCAAGGGGC

ACGATGGCCTTTACCAGGGTCTCAGTACAGCCACCAAGGACACCTACGACGC

CCTTCACATGCAGGCCCTGCCCCCTCGC

IgG4 Hinge (amino acid sequence)
                                                    (SEQ ID NO: 36)
ESKYGPPCPPCPAPEFLGGPSVFLFPPKPKDTLMISRTPEVTCVVVDVSQEDPEVQFNWYVDGV

EVHNAKTKPREEQFNSTYRVVSVLTVLHQDWLNGKEYKCKVSNKGLPSSIEKTISKAKGQPRE

PQVYTLPPSQEEMTKNQVSLTCLVKGFYPSDIAVEWESNGQPENNYKTTPPVLDSDGSFFLYSR

LTVDKSRWQEGNVFSCSVMHEALHNHYTQKSLSLSLGKM

IgG4 Hinge (nucleotide sequence)
                                                    (SEQ ID NO: 37)
GAGAGCAAGTACGGCCCTCCCTGCCCCCCTTGCCCTGCCCCCGAGTTCCTGGGCGGACCCA

GCGTGTTCCTGTTCCCCCCAAGCCCAAGGACACCCTGATGATCAGCCGGACCCCCGAGGT

GACCTGTGTGGTGGTGGACGTGTCCCAGGAGGACCCCGAGGTCCAGTTCAACTGGTACGTG

GACGGCGTGGAGGTGCACAACGCCAAGACCAAGCCCCGGGAGGAGCAGTTCAATAGCACC

TACCGGGTGGTGTCCGTGCTGACCGTGCTGCACCAGGACTGGCTGAACGGCAAGGAATAC

AAGTGTAAGGTGTCCAACAAGGGCCTGCCCAGCAGCATCGAGAAAACCATCAGCAAGGCC

AAGGGCCAGCCTCGGGAGCCCCAGGTGTACACCCTGCCCCCTAGCCAAGAGGAGATGACC

AAGAACCAGGTGTCCCTGACCTGCCTGGTGAAGGGCTTCTACCCCAGCGACATCGCCGTGG
```

```
AGTGGGAGAGCAACGGCCAGCCCGAGAACAACTACAAGACCACCCCCCCTGTGCTGGACA

GCGACGGCAGCTTCTTCCTGTACAGCCGGCTGACCGTGGACAAGAGCCGGTGGCAGGAGG

GCAACGTCTTTAGCTGCTCCGTGATGCACGAGGCCCTGCACAACCACTACACCCAGAAGAG

CCTGAGCCTGTCCCTGGGCAAGATG
```

EF1 alpha promoter (SEQ ID NO: 11)

```
CGTGAGGCTCCGGTGCCCGTCAGTGGGCAGAGCGCACATCGCCCACAGTCCCCGA

GAAGTTGGGGGGAGGGGTCGGCAATTGAACCGGTGCCTAGAGAAGGTGGCGCGGG

GTAAACTGGGAAAGTGATGTCGTGTACTGGCTCCGCCTTTTTCCCGAGGGTGGGGG

AGAACCGTATATAAGTGCAGTAGTCGCCGTGAACGTTCTTTTTCGCAACGGGTTTG

CCGCCAGAACACAGGTAAGTGCCGTGTGTGGTTCCCGCGGGCCTGGCCTCTTTACG

GGTTATGGCCCTTGCGTGCCTTGAATTACTTCCACCTGGCTGCAGTACGTGATTCTT

GATCCCGAGCTTCGGGTTGGAAGTGGGTGGGAGAGTTCGAGGCCTTGCGCTTAAG

GAGCCCCTTCGCCTCGTGCTTGAGTTGAGGCCTGGCCTGGGCGCTGGGGCCGCCGC

GTGCGAATCTGGTGGCACCTTCGCGCCTGTCTCGCTGCTTTCGATAAGTCTCTAGCC

ATTTAAAATTTTTGATGACCTGCTGCGACGCTTTTTTTCTGGCAAGATAGTCTTGTA

AATGCGGGCCAAGATCTGCACACTGGTATTTCGGTTTTTGGGGCCGCGGGCGGCGA

CGGGGCCCGTGCGTCCCAGCGCACATGTTCGGCGAGGCGGGGCCTGCGAGCGCGG

CCACCGAGAATCGGACGGGGGTAGTCTCAAGCTGGCCGGCCTGCTCTGGTGCCTGG

CCTCGCGCCGCCGTGTATCGCCCCGCCCTGGGCGGCAAGGCTGGCCCGGTCGGCAC

CAGTTGCGTGAGCGGAAAGATGGCCGCTTCCCGGCCCTGCTGCAGGGAGCTCAAA

ATGGAGGACGCGGCGCTCGGGAGAGCGGGCGGGTGAGTCACCCACACAAAGGAA

AAGGGCCTTTCCGTCCTCAGCCGTCGCTTCATGTGACTCCACGGAGTACCGGGCGC

CGTCCAGGCACCTCGATTAGTTCTCGAGCTTTTGGAGTACGTCGTCTTTAGGTTGGG

GGGAGGGGTTTTATGCGATGGAGTTTCCCCACACTGAGTGGGTGGAGACTGAAGTT

AGGCCAGCTTGGCACTTGATGTAATTCTCCTTGGAATTTGCCCTTTTTGAGTTTGGA

TCTTGGTTCATTCTCAAGCCTCAGACAGTGGTTCAAAGTTTTTTTCTTCCATTTCAG

GTGTCGTGA.
```

Gly/Ser (SEQ ID NO: 25)

GGGGS

Gly/Ser (SEQ ID NO: 363): This sequence may encompass
1-6 "Gly Gly Gly Gly Ser" repeating units
GGGGSGGGGS GGGGSGGGGS GGGGSGGGGS Gly/Ser (SEQ ID NO: 27)

GGGGSGGGGS GGGGSGGGGS

Gly/Ser (SEQ ID NO: 28)

GGGGSGGGGS GGGGS

Gly/Ser (SEQ ID NO: 29)

GGGS

PolyA (SEQ ID NO: 30)

```
aaaaaaaaaa aaaaaaaaaa aaaaaaaaaa aaaaaaaaaa aaaaaaaaaa aaaaaaaaaa    60
aaaaaaaaaa aaaaaaaaaa aaaaaaaaaa aaaaaaaaaa aaaaaaaaaa aaaaaaaaaa   120
```

-continued

```
aaaaaaaaaa aaaaaaaaaa aaaaaaaaaa aaaaaaaaaa aaaaaaaaaa aaaaaaaaaa    180
aaaaaaaaaa aaaaaaaaaa aaaaaaaaaa aaaaaaaaaa aaaaaaaaaa aaaaaaaaaa    240
aaaaaaaaaa aaaaaaaaaa aaaaaaaaaa aaaaaaaaaa aaaaaaaaaa aaaaaaaaaa    300
aaaaaaaaaa aaaaaaaaaa aaaaaaaaaa aaaaaaaaaa aaaaaaaaaa aaaaaaaaaa    360
aaaaaaaaaa aaaaaaaaaa aaaaaaaaaa aaaaaaaaaa aaaaaaaaaa aaaaaaaaaa    420
aaaaaaaaaa aaaaaaaaaa aaaaaaaaaa aaaaaaaaaa aaaaaaaaaa aaaaaaaaaa    480
aaaaaaaaaa aaaaaaaaaa aaaaaaaaaa aaaaaaaaaa aaaaaaaaaa aaaaaaaaaa    540
aaaaaaaaaa aaaaaaaaaa aaaaaaaaaa aaaaaaaaaa aaaaaaaaaa aaaaaaaaaa    600
aaaaaaaaaa aaaaaaaaaa aaaaaaaaaa aaaaaaaaaa aaaaaaaaaa aaaaaaaaaa    660
aaaaaaaaaa aaaaaaaaaa aaaaaaaaaa aaaaaaaaaa aaaaaaaaaa aaaaaaaaaa    720
aaaaaaaaaa aaaaaaaaaa aaaaaaaaaa aaaaaaaaaa aaaaaaaaaa aaaaaaaaaa    780
aaaaaaaaaa aaaaaaaaaa aaaaaaaaaa aaaaaaaaaa aaaaaaaaaa aaaaaaaaaa    840
aaaaaaaaaa aaaaaaaaaa aaaaaaaaaa aaaaaaaaaa aaaaaaaaaa aaaaaaaaaa    900
aaaaaaaaaa aaaaaaaaaa aaaaaaaaaa aaaaaaaaaa aaaaaaaaaa aaaaaaaaaa    960
aaaaaaaaaa aaaaaaaaaa aaaaaaaaaa aaaaaaaaaa aaaaaaaaaa aaaaaaaaaa   1020
aaaaaaaaaa aaaaaaaaaa aaaaaaaaaa aaaaaaaaaa aaaaaaaaaa aaaaaaaaaa   1080
aaaaaaaaaa aaaaaaaaaa aaaaaaaaaa aaaaaaaaaa aaaaaaaaaa aaaaaaaaaa   1140
aaaaaaaaaa aaaaaaaaaa aaaaaaaaaa aaaaaaaaaa aaaaaaaaaa aaaaaaaaaa   1200
aaaaaaaaaa aaaaaaaaaa aaaaaaaaaa aaaaaaaaaa aaaaaaaaaa aaaaaaaaaa   1260
aaaaaaaaaa aaaaaaaaaa aaaaaaaaaa aaaaaaaaaa aaaaaaaaaa aaaaaaaaaa   1320
aaaaaaaaaa aaaaaaaaaa aaaaaaaaaa aaaaaaaaaa aaaaaaaaaa aaaaaaaaaa   1380
aaaaaaaaaa aaaaaaaaaa aaaaaaaaaa aaaaaaaaaa aaaaaaaaaa aaaaaaaaaa   1440
aaaaaaaaaa aaaaaaaaaa aaaaaaaaaa aaaaaaaaaa aaaaaaaaaa aaaaaaaaaa   1500
aaaaaaaaaa aaaaaaaaaa aaaaaaaaaa aaaaaaaaaa aaaaaaaaaa aaaaaaaaaa   1560
aaaaaaaaaa aaaaaaaaaa aaaaaaaaaa aaaaaaaaaa aaaaaaaaaa aaaaaaaaaa   1620
aaaaaaaaaa aaaaaaaaaa aaaaaaaaaa aaaaaaaaaa aaaaaaaaaa aaaaaaaaaa   1680
aaaaaaaaaa aaaaaaaaaa aaaaaaaaaa aaaaaaaaaa aaaaaaaaaa aaaaaaaaaa   1740
aaaaaaaaaa aaaaaaaaaa aaaaaaaaaa aaaaaaaaaa aaaaaaaaaa aaaaaaaaaa   1800
aaaaaaaaaa aaaaaaaaaa aaaaaaaaaa aaaaaaaaaa aaaaaaaaaa aaaaaaaaaa   1860
aaaaaaaaaa aaaaaaaaaa aaaaaaaaaa aaaaaaaaaa aaaaaaaaaa aaaaaaaaaa   1920
aaaaaaaaaa aaaaaaaaaa aaaaaaaaaa aaaaaaaaaa aaaaaaaaaa aaaaaaaaaa   1980
aaaaaaaaaa aaaaaaaaaa aaaaaaaaaa aaaaaaaaaa aaaaaaaaaa aaaaaaaaaa   2040
aaaaaaaaaa aaaaaaaaaa aaaaaaaaaa aaaaaaaaaa aaaaaaaaaa aaaaaaaaaa   2100
aaaaaaaaaa aaaaaaaaaa aaaaaaaaaa aaaaaaaaaa aaaaaaaaaa aaaaaaaaaa   2160
aaaaaaaaaa aaaaaaaaaa aaaaaaaaaa aaaaaaaaaa aaaaaaaaaa aaaaaaaaaa   2220
aaaaaaaaaa aaaaaaaaaa aaaaaaaaaa aaaaaaaaaa aaaaaaaaaa aaaaaaaaaa   2280
aaaaaaaaaa aaaaaaaaaa aaaaaaaaaa aaaaaaaaaa aaaaaaaaaa aaaaaaaaaa   2340
aaaaaaaaaa aaaaaaaaaa aaaaaaaaaa aaaaaaaaaa aaaaaaaaaa aaaaaaaaaa   2400
aaaaaaaaaa aaaaaaaaaa aaaaaaaaaa aaaaaaaaaa aaaaaaaaaa aaaaaaaaaa   2460
aaaaaaaaaa aaaaaaaaaa aaaaaaaaaa aaaaaaaaaa aaaaaaaaaa aaaaaaaaaa   2520
aaaaaaaaaa aaaaaaaaaa aaaaaaaaaa aaaaaaaaaa aaaaaaaaaa aaaaaaaaaa   2580
```

-continued

```
aaaaaaaaaa aaaaaaaaaa aaaaaaaaaa aaaaaaaaaa aaaaaaaaaa aaaaaaaaaa    2640
aaaaaaaaaa aaaaaaaaaa aaaaaaaaaa aaaaaaaaaa aaaaaaaaaa aaaaaaaaaa    2700
aaaaaaaaaa aaaaaaaaaa aaaaaaaaaa aaaaaaaaaa aaaaaaaaaa aaaaaaaaaa    2760
aaaaaaaaaa aaaaaaaaaa aaaaaaaaaa aaaaaaaaaa aaaaaaaaaa aaaaaaaaaa    2820
aaaaaaaaaa aaaaaaaaaa aaaaaaaaaa aaaaaaaaaa aaaaaaaaaa aaaaaaaaaa    2880
aaaaaaaaaa aaaaaaaaaa aaaaaaaaaa aaaaaaaaaa aaaaaaaaaa aaaaaaaaaa    2940
aaaaaaaaaa aaaaaaaaaa aaaaaaaaaa aaaaaaaaaa aaaaaaaaaa aaaaaaaaaa    3000
aaaaaaaaaa aaaaaaaaaa aaaaaaaaaa aaaaaaaaaa aaaaaaaaaa aaaaaaaaaa    3060
aaaaaaaaaa aaaaaaaaaa aaaaaaaaaa aaaaaaaaaa aaaaaaaaaa aaaaaaaaaa    3120
aaaaaaaaaa aaaaaaaaaa aaaaaaaaaa aaaaaaaaaa aaaaaaaaaa aaaaaaaaaa    3180
aaaaaaaaaa aaaaaaaaaa aaaaaaaaaa aaaaaaaaaa aaaaaaaaaa aaaaaaaaaa    3240
aaaaaaaaaa aaaaaaaaaa aaaaaaaaaa aaaaaaaaaa aaaaaaaaaa aaaaaaaaaa    3300
aaaaaaaaaa aaaaaaaaaa aaaaaaaaaa aaaaaaaaaa aaaaaaaaaa aaaaaaaaaa    3360
aaaaaaaaaa aaaaaaaaaa aaaaaaaaaa aaaaaaaaaa aaaaaaaaaa aaaaaaaaaa    3420
aaaaaaaaaa aaaaaaaaaa aaaaaaaaaa aaaaaaaaaa aaaaaaaaaa aaaaaaaaaa    3480
aaaaaaaaaa aaaaaaaaaa aaaaaaaaaa aaaaaaaaaa aaaaaaaaaa aaaaaaaaaa    3540
aaaaaaaaaa aaaaaaaaaa aaaaaaaaaa aaaaaaaaaa aaaaaaaaaa aaaaaaaaaa    3600
aaaaaaaaaa aaaaaaaaaa aaaaaaaaaa aaaaaaaaaa aaaaaaaaaa aaaaaaaaaa    3660
aaaaaaaaaa aaaaaaaaaa aaaaaaaaaa aaaaaaaaaa aaaaaaaaaa aaaaaaaaaa    3720
aaaaaaaaaa aaaaaaaaaa aaaaaaaaaa aaaaaaaaaa aaaaaaaaaa aaaaaaaaaa    3780
aaaaaaaaaa aaaaaaaaaa aaaaaaaaaa aaaaaaaaaa aaaaaaaaaa aaaaaaaaaa    3840
aaaaaaaaaa aaaaaaaaaa aaaaaaaaaa aaaaaaaaaa aaaaaaaaaa aaaaaaaaaa    3900
aaaaaaaaaa aaaaaaaaaa aaaaaaaaaa aaaaaaaaaa aaaaaaaaaa aaaaaaaaaa    3960
aaaaaaaaaa aaaaaaaaaa aaaaaaaaaa aaaaaaaaaa aaaaaaaaaa aaaaaaaaaa    4020
aaaaaaaaaa aaaaaaaaaa aaaaaaaaaa aaaaaaaaaa aaaaaaaaaa aaaaaaaaaa    4080
aaaaaaaaaa aaaaaaaaaa aaaaaaaaaa aaaaaaaaaa aaaaaaaaaa aaaaaaaaaa    4140
aaaaaaaaaa aaaaaaaaaa aaaaaaaaaa aaaaaaaaaa aaaaaaaaaa aaaaaaaaaa    4200
aaaaaaaaaa aaaaaaaaaa aaaaaaaaaa aaaaaaaaaa aaaaaaaaaa aaaaaaaaaa    4260
aaaaaaaaaa aaaaaaaaaa aaaaaaaaaa aaaaaaaaaa aaaaaaaaaa aaaaaaaaaa    4320
aaaaaaaaaa aaaaaaaaaa aaaaaaaaaa aaaaaaaaaa aaaaaaaaaa aaaaaaaaaa    4380
aaaaaaaaaa aaaaaaaaaa aaaaaaaaaa aaaaaaaaaa aaaaaaaaaa aaaaaaaaaa    4440
aaaaaaaaaa aaaaaaaaaa aaaaaaaaaa aaaaaaaaaa aaaaaaaaaa aaaaaaaaaa    4500
aaaaaaaaaa aaaaaaaaaa aaaaaaaaaa aaaaaaaaaa aaaaaaaaaa aaaaaaaaaa    4560
aaaaaaaaaa aaaaaaaaaa aaaaaaaaaa aaaaaaaaaa aaaaaaaaaa aaaaaaaaaa    4620
aaaaaaaaaa aaaaaaaaaa aaaaaaaaaa aaaaaaaaaa aaaaaaaaaa aaaaaaaaaa    4680
aaaaaaaaaa aaaaaaaaaa aaaaaaaaaa aaaaaaaaaa aaaaaaaaaa aaaaaaaaaa    4740
aaaaaaaaaa aaaaaaaaaa aaaaaaaaaa aaaaaaaaaa aaaaaaaaaa aaaaaaaaaa    4800
aaaaaaaaaa aaaaaaaaaa aaaaaaaaaa aaaaaaaaaa aaaaaaaaaa aaaaaaaaaa    4860
aaaaaaaaaa aaaaaaaaaa aaaaaaaaaa aaaaaaaaaa aaaaaaaaaa aaaaaaaaaa    4920
```

-continued

```
aaaaaaaaaa aaaaaaaaaa aaaaaaaaaa aaaaaaaaaa aaaaaaaaaa aaaaaaaaaa    4980
aaaaaaaaaa aaaaaaaaaa                                                 5000
```

PolyA
(SEQ ID NO: 31)
```
tttttttttt tttttttttt tttttttttt tttttttttt tttttttttt tttttttttt      60
tttttttttt tttttttttt tttttttttt tttttttttt                           100
```

PolyA
(SEQ ID NO: 32)
```
tttttttttt tttttttttt tttttttttt tttttttttt tttttttttt tttttttttt      60
tttttttttt tttttttttt tttttttttt tttttttttt tttttttttt tttttttttt     120
tttttttttt tttttttttt tttttttttt tttttttttt tttttttttt tttttttttt     180
tttttttttt tttttttttt tttttttttt tttttttttt tttttttttt tttttttttt     240
tttttttttt tttttttttt tttttttttt tttttttttt tttttttttt tttttttttt     300
tttttttttt tttttttttt tttttttttt tttttttttt tttttttttt tttttttttt     360
tttttttttt tttttttttt tttttttttt tttttttttt tttttttttt tttttttttt     420
tttttttttt tttttttttt tttttttttt tttttttttt tttttttttt tttttttttt     480
tttttttttt tttttttttt tttttttttt tttttttttt tttttttttt tttttttttt     540
tttttttttt tttttttttt tttttttttt tttttttttt tttttttttt tttttttttt     600
tttttttttt tttttttttt tttttttttt tttttttttt tttttttttt tttttttttt     660
tttttttttt tttttttttt tttttttttt tttttttttt tttttttttt tttttttttt     720
tttttttttt tttttttttt tttttttttt tttttttttt tttttttttt tttttttttt     780
tttttttttt tttttttttt tttttttttt tttttttttt tttttttttt tttttttttt     840
tttttttttt tttttttttt tttttttttt tttttttttt tttttttttt tttttttttt     900
tttttttttt tttttttttt tttttttttt tttttttttt tttttttttt tttttttttt     960
tttttttttt tttttttttt tttttttttt tttttttttt tttttttttt tttttttttt    1020
tttttttttt tttttttttt tttttttttt tttttttttt tttttttttt tttttttttt    1080
tttttttttt tttttttttt tttttttttt tttttttttt tttttttttt tttttttttt    1140
tttttttttt tttttttttt tttttttttt tttttttttt tttttttttt tttttttttt    1200
tttttttttt tttttttttt tttttttttt tttttttttt tttttttttt tttttttttt    1260
tttttttttt tttttttttt tttttttttt tttttttttt tttttttttt tttttttttt    1320
tttttttttt tttttttttt tttttttttt tttttttttt tttttttttt tttttttttt    1380
tttttttttt tttttttttt tttttttttt tttttttttt tttttttttt tttttttttt    1440
tttttttttt tttttttttt tttttttttt tttttttttt tttttttttt tttttttttt    1500
tttttttttt tttttttttt tttttttttt tttttttttt tttttttttt tttttttttt    1560
tttttttttt tttttttttt tttttttttt tttttttttt tttttttttt tttttttttt    1620
tttttttttt tttttttttt tttttttttt tttttttttt tttttttttt tttttttttt    1680
tttttttttt tttttttttt tttttttttt tttttttttt tttttttttt tttttttttt    1740
tttttttttt tttttttttt tttttttttt tttttttttt tttttttttt tttttttttt    1800
tttttttttt tttttttttt tttttttttt tttttttttt tttttttttt tttttttttt    1860
tttttttttt tttttttttt tttttttttt tttttttttt tttttttttt tttttttttt    1920
tttttttttt tttttttttt tttttttttt tttttttttt tttttttttt tttttttttt    1980
tttttttttt tttttttttt tttttttttt tttttttttt tttttttttt tttttttttt    2040
tttttttttt tttttttttt tttttttttt tttttttttt tttttttttt tttttttttt    2100
```

-continued

| | | | | | | |
|---|---|---|---|---|---|---|
|tttttttttt|tttttttttt|tttttttttt|tttttttttt|tttttttttt|tttttttttt|2160|
|tttttttttt|tttttttttt|tttttttttt|tttttttttt|tttttttttt|tttttttttt|2220|
|tttttttttt|tttttttttt|tttttttttt|tttttttttt|tttttttttt|tttttttttt|2280|
|tttttttttt|tttttttttt|tttttttttt|tttttttttt|tttttttttt|tttttttttt|2340|
|tttttttttt|tttttttttt|tttttttttt|tttttttttt|tttttttttt|tttttttttt|2400|
|tttttttttt|tttttttttt|tttttttttt|tttttttttt|tttttttttt|tttttttttt|2460|
|tttttttttt|tttttttttt|tttttttttt|tttttttttt|tttttttttt|tttttttttt|2520|
|tttttttttt|tttttttttt|tttttttttt|tttttttttt|tttttttttt|tttttttttt|2580|
|tttttttttt|tttttttttt|tttttttttt|tttttttttt|tttttttttt|tttttttttt|2640|
|tttttttttt|tttttttttt|tttttttttt|tttttttttt|tttttttttt|tttttttttt|2700|
|tttttttttt|tttttttttt|tttttttttt|tttttttttt|tttttttttt|tttttttttt|2760|
|tttttttttt|tttttttttt|tttttttttt|tttttttttt|tttttttttt|tttttttttt|2820|
|tttttttttt|tttttttttt|tttttttttt|tttttttttt|tttttttttt|tttttttttt|2880|
|tttttttttt|tttttttttt|tttttttttt|tttttttttt|tttttttttt|tttttttttt|2940|
|tttttttttt|tttttttttt|tttttttttt|tttttttttt|tttttttttt|tttttttttt|3000|
|tttttttttt|tttttttttt|tttttttttt|tttttttttt|tttttttttt|tttttttttt|3060|
|tttttttttt|tttttttttt|tttttttttt|tttttttttt|tttttttttt|tttttttttt|3120|
|tttttttttt|tttttttttt|tttttttttt|tttttttttt|tttttttttt|tttttttttt|3180|
|tttttttttt|tttttttttt|tttttttttt|tttttttttt|tttttttttt|tttttttttt|3240|
|tttttttttt|tttttttttt|tttttttttt|tttttttttt|tttttttttt|tttttttttt|3300|
|tttttttttt|tttttttttt|tttttttttt|tttttttttt|tttttttttt|tttttttttt|3360|
|tttttttttt|tttttttttt|tttttttttt|tttttttttt|tttttttttt|tttttttttt|3420|
|tttttttttt|tttttttttt|tttttttttt|tttttttttt|tttttttttt|tttttttttt|3480|
|tttttttttt|tttttttttt|tttttttttt|tttttttttt|tttttttttt|tttttttttt|3540|
|tttttttttt|tttttttttt|tttttttttt|tttttttttt|tttttttttt|tttttttttt|3600|
|tttttttttt|tttttttttt|tttttttttt|tttttttttt|tttttttttt|tttttttttt|3660|
|tttttttttt|tttttttttt|tttttttttt|tttttttttt|tttttttttt|tttttttttt|3720|
|tttttttttt|tttttttttt|tttttttttt|tttttttttt|tttttttttt|tttttttttt|3780|
|tttttttttt|tttttttttt|tttttttttt|tttttttttt|tttttttttt|tttttttttt|3840|
|tttttttttt|tttttttttt|tttttttttt|tttttttttt|tttttttttt|tttttttttt|3900|
|tttttttttt|tttttttttt|tttttttttt|tttttttttt|tttttttttt|tttttttttt|3960|
|tttttttttt|tttttttttt|tttttttttt|tttttttttt|tttttttttt|tttttttttt|4020|
|tttttttttt|tttttttttt|tttttttttt|tttttttttt|tttttttttt|tttttttttt|4080|
|tttttttttt|tttttttttt|tttttttttt|tttttttttt|tttttttttt|tttttttttt|4140|
|tttttttttt|tttttttttt|tttttttttt|tttttttttt|tttttttttt|tttttttttt|4200|
|tttttttttt|tttttttttt|tttttttttt|tttttttttt|tttttttttt|tttttttttt|4260|
|tttttttttt|tttttttttt|tttttttttt|tttttttttt|tttttttttt|tttttttttt|4320|
|tttttttttt|tttttttttt|tttttttttt|tttttttttt|tttttttttt|tttttttttt|4380|
|tttttttttt|tttttttttt|tttttttttt|tttttttttt|tttttttttt|tttttttttt|4440|
|tttttttttt|tttttttttt|tttttttttt|tttttttttt|tttttttttt|tttttttttt|4500|

-continued

| | |
|---|---|
| tttttttttt tttttttttt tttttttttt tttttttttt tttttttttt tttttttttt | 4560 |
| tttttttttt tttttttttt tttttttttt tttttttttt tttttttttt tttttttttt | 4620 |
| tttttttttt tttttttttt tttttttttt tttttttttt tttttttttt tttttttttt | 4680 |
| tttttttttt tttttttttt tttttttttt tttttttttt tttttttttt tttttttttt | 4740 |
| tttttttttt tttttttttt tttttttttt tttttttttt tttttttttt tttttttttt | 4800 |
| tttttttttt tttttttttt tttttttttt tttttttttt tttttttttt tttttttttt | 4860 |
| tttttttttt tttttttttt tttttttttt tttttttttt tttttttttt tttttttttt | 4920 |
| tttttttttt tttttttttt tttttttttt tttttttttt tttttttttt tttttttttt | 4980 |
| tttttttttt tttttttttt | 5000 |

PolyA (SEQ ID NO: 33)

| | |
|---|---|
| aaaaaaaaaa aaaaaaaaaa aaaaaaaaaa aaaaaaaaaa aaaaaaaaaa aaaaaaaaaa | 60 |
| aaaaaaaaaa aaaaaaaaaa aaaaaaaaaa aaaaaaaaaa aaaaaaaaaa aaaaaaaaaa | 120 |
| aaaaaaaaaa aaaaaaaaaa aaaaaaaaaa aaaaaaaaaa aaaaaaaaaa aaaaaaaaaa | 180 |
| aaaaaaaaaa aaaaaaaaaa aaaaaaaaaa aaaaaaaaaa aaaaaaaaaa aaaaaaaaaa | 240 |
| aaaaaaaaaa aaaaaaaaaa aaaaaaaaaa aaaaaaaaaa aaaaaaaaaa aaaaaaaaaa | 300 |
| aaaaaaaaaa aaaaaaaaaa aaaaaaaaaa aaaaaaaaaa aaaaaaaaaa aaaaaaaaaa | 360 |
| aaaaaaaaaa aaaaaaaaaa aaaaaaaaaa aaaaaaaaaa aaaaaaaaaa aaaaaaaaaa | 420 |
| aaaaaaaaaa aaaaaaaaaa aaaaaaaaaa aaaaaaaaaa aaaaaaaaaa aaaaaaaaaa | 480 |
| aaaaaaaaaa aaaaaaaaaa aaaaaaaaaa aaaaaaaaaa aaaaaaaaaa aaaaaaaaaa | 540 |
| aaaaaaaaaa aaaaaaaaaa aaaaaaaaaa aaaaaaaaaa aaaaaaaaaa aaaaaaaaaa | 600 |
| aaaaaaaaaa aaaaaaaaaa aaaaaaaaaa aaaaaaaaaa aaaaaaaaaa aaaaaaaaaa | 660 |
| aaaaaaaaaa aaaaaaaaaa aaaaaaaaaa aaaaaaaaaa aaaaaaaaaa aaaaaaaaaa | 720 |
| aaaaaaaaaa aaaaaaaaaa aaaaaaaaaa aaaaaaaaaa aaaaaaaaaa aaaaaaaaaa | 780 |
| aaaaaaaaaa aaaaaaaaaa aaaaaaaaaa aaaaaaaaaa aaaaaaaaaa aaaaaaaaaa | 840 |
| aaaaaaaaaa aaaaaaaaaa aaaaaaaaaa aaaaaaaaaa aaaaaaaaaa aaaaaaaaaa | 900 |
| aaaaaaaaaa aaaaaaaaaa aaaaaaaaaa aaaaaaaaaa aaaaaaaaaa aaaaaaaaaa | 960 |
| aaaaaaaaaa aaaaaaaaaa aaaaaaaaaa aaaaaaaaaa aaaaaaaaaa aaaaaaaaaa | 1020 |
| aaaaaaaaaa aaaaaaaaaa aaaaaaaaaa aaaaaaaaaa aaaaaaaaaa aaaaaaaaaa | 1080 |
| aaaaaaaaaa aaaaaaaaaa aaaaaaaaaa aaaaaaaaaa aaaaaaaaaa aaaaaaaaaa | 1140 |
| aaaaaaaaaa aaaaaaaaaa aaaaaaaaaa aaaaaaaaaa aaaaaaaaaa aaaaaaaaaa | 1200 |
| aaaaaaaaaa aaaaaaaaaa aaaaaaaaaa aaaaaaaaaa aaaaaaaaaa aaaaaaaaaa | 1260 |
| aaaaaaaaaa aaaaaaaaaa aaaaaaaaaa aaaaaaaaaa aaaaaaaaaa aaaaaaaaaa | 1320 |
| aaaaaaaaaa aaaaaaaaaa aaaaaaaaaa aaaaaaaaaa aaaaaaaaaa aaaaaaaaaa | 1380 |
| aaaaaaaaaa aaaaaaaaaa aaaaaaaaaa aaaaaaaaaa aaaaaaaaaa aaaaaaaaaa | 1440 |
| aaaaaaaaaa aaaaaaaaaa aaaaaaaaaa aaaaaaaaaa aaaaaaaaaa aaaaaaaaaa | 1500 |
| aaaaaaaaaa aaaaaaaaaa aaaaaaaaaa aaaaaaaaaa aaaaaaaaaa aaaaaaaaaa | 1560 |
| aaaaaaaaaa aaaaaaaaaa aaaaaaaaaa aaaaaaaaaa aaaaaaaaaa aaaaaaaaaa | 1620 |
| aaaaaaaaaa aaaaaaaaaa aaaaaaaaaa aaaaaaaaaa aaaaaaaaaa aaaaaaaaaa | 1680 |
| aaaaaaaaaa aaaaaaaaaa aaaaaaaaaa aaaaaaaaaa aaaaaaaaaa aaaaaaaaaa | 1740 |
| aaaaaaaaaa aaaaaaaaaa aaaaaaaaaa aaaaaaaaaa aaaaaaaaaa aaaaaaaaaa | 1800 |
| aaaaaaaaaa aaaaaaaaaa aaaaaaaaaa aaaaaaaaaa aaaaaaaaaa aaaaaaaaaa | 1860 |

-continued

```
aaaaaaaaaa aaaaaaaaaa aaaaaaaaaa aaaaaaaaaa aaaaaaaaaa aaaaaaaaaa   1920
aaaaaaaaaa aaaaaaaaaa aaaaaaaaaa aaaaaaaaaa aaaaaaaaaa aaaaaaaaaa   1980
aaaaaaaaaa aaaaaaaaaa aaaaaaaaaa aaaaaaaaaa aaaaaaaaaa aaaaaaaaaa   2040
aaaaaaaaaa aaaaaaaaaa aaaaaaaaaa aaaaaaaaaa aaaaaaaaaa aaaaaaaaaa   2100
aaaaaaaaaa aaaaaaaaaa aaaaaaaaaa aaaaaaaaaa aaaaaaaaaa aaaaaaaaaa   2160
aaaaaaaaaa aaaaaaaaaa aaaaaaaaaa aaaaaaaaaa aaaaaaaaaa aaaaaaaaaa   2220
aaaaaaaaaa aaaaaaaaaa aaaaaaaaaa aaaaaaaaaa aaaaaaaaaa aaaaaaaaaa   2280
aaaaaaaaaa aaaaaaaaaa aaaaaaaaaa aaaaaaaaaa aaaaaaaaaa aaaaaaaaaa   2340
aaaaaaaaaa aaaaaaaaaa aaaaaaaaaa aaaaaaaaaa aaaaaaaaaa aaaaaaaaaa   2400
aaaaaaaaaa aaaaaaaaaa aaaaaaaaaa aaaaaaaaaa aaaaaaaaaa aaaaaaaaaa   2460
aaaaaaaaaa aaaaaaaaaa aaaaaaaaaa aaaaaaaaaa aaaaaaaaaa aaaaaaaaaa   2520
aaaaaaaaaa aaaaaaaaaa aaaaaaaaaa aaaaaaaaaa aaaaaaaaaa aaaaaaaaaa   2580
aaaaaaaaaa aaaaaaaaaa aaaaaaaaaa aaaaaaaaaa aaaaaaaaaa aaaaaaaaaa   2640
aaaaaaaaaa aaaaaaaaaa aaaaaaaaaa aaaaaaaaaa aaaaaaaaaa aaaaaaaaaa   2700
aaaaaaaaaa aaaaaaaaaa aaaaaaaaaa aaaaaaaaaa aaaaaaaaaa aaaaaaaaaa   2760
aaaaaaaaaa aaaaaaaaaa aaaaaaaaaa aaaaaaaaaa aaaaaaaaaa aaaaaaaaaa   2820
aaaaaaaaaa aaaaaaaaaa aaaaaaaaaa aaaaaaaaaa aaaaaaaaaa aaaaaaaaaa   2880
aaaaaaaaaa aaaaaaaaaa aaaaaaaaaa aaaaaaaaaa aaaaaaaaaa aaaaaaaaaa   2940
aaaaaaaaaa aaaaaaaaaa aaaaaaaaaa aaaaaaaaaa aaaaaaaaaa aaaaaaaaaa   3000
aaaaaaaaaa aaaaaaaaaa aaaaaaaaaa aaaaaaaaaa aaaaaaaaaa aaaaaaaaaa   3060
aaaaaaaaaa aaaaaaaaaa aaaaaaaaaa aaaaaaaaaa aaaaaaaaaa aaaaaaaaaa   3120
aaaaaaaaaa aaaaaaaaaa aaaaaaaaaa aaaaaaaaaa aaaaaaaaaa aaaaaaaaaa   3180
aaaaaaaaaa aaaaaaaaaa aaaaaaaaaa aaaaaaaaaa aaaaaaaaaa aaaaaaaaaa   3240
aaaaaaaaaa aaaaaaaaaa aaaaaaaaaa aaaaaaaaaa aaaaaaaaaa aaaaaaaaaa   3300
aaaaaaaaaa aaaaaaaaaa aaaaaaaaaa aaaaaaaaaa aaaaaaaaaa aaaaaaaaaa   3360
aaaaaaaaaa aaaaaaaaaa aaaaaaaaaa aaaaaaaaaa aaaaaaaaaa aaaaaaaaaa   3420
aaaaaaaaaa aaaaaaaaaa aaaaaaaaaa aaaaaaaaaa aaaaaaaaaa aaaaaaaaaa   3480
aaaaaaaaaa aaaaaaaaaa aaaaaaaaaa aaaaaaaaaa aaaaaaaaaa aaaaaaaaaa   3540
aaaaaaaaaa aaaaaaaaaa aaaaaaaaaa aaaaaaaaaa aaaaaaaaaa aaaaaaaaaa   3600
aaaaaaaaaa aaaaaaaaaa aaaaaaaaaa aaaaaaaaaa aaaaaaaaaa aaaaaaaaaa   3660
aaaaaaaaaa aaaaaaaaaa aaaaaaaaaa aaaaaaaaaa aaaaaaaaaa aaaaaaaaaa   3720
aaaaaaaaaa aaaaaaaaaa aaaaaaaaaa aaaaaaaaaa aaaaaaaaaa aaaaaaaaaa   3780
aaaaaaaaaa aaaaaaaaaa aaaaaaaaaa aaaaaaaaaa aaaaaaaaaa aaaaaaaaaa   3840
aaaaaaaaaa aaaaaaaaaa aaaaaaaaaa aaaaaaaaaa aaaaaaaaaa aaaaaaaaaa   3900
aaaaaaaaaa aaaaaaaaaa aaaaaaaaaa aaaaaaaaaa aaaaaaaaaa aaaaaaaaaa   3960
aaaaaaaaaa aaaaaaaaaa aaaaaaaaaa aaaaaaaaaa aaaaaaaaaa aaaaaaaaaa   4020
aaaaaaaaaa aaaaaaaaaa aaaaaaaaaa aaaaaaaaaa aaaaaaaaaa aaaaaaaaaa   4080
aaaaaaaaaa aaaaaaaaaa aaaaaaaaaa aaaaaaaaaa aaaaaaaaaa aaaaaaaaaa   4140
aaaaaaaaaa aaaaaaaaaa aaaaaaaaaa aaaaaaaaaa aaaaaaaaaa aaaaaaaaaa   4200
aaaaaaaaaa aaaaaaaaaa aaaaaaaaaa aaaaaaaaaa aaaaaaaaaa aaaaaaaaaa   4260
```

-continued

```
aaaaaaaaaa aaaaaaaaaa aaaaaaaaaa aaaaaaaaaa aaaaaaaaaa aaaaaaaaaa   4320
aaaaaaaaaa aaaaaaaaaa aaaaaaaaaa aaaaaaaaaa aaaaaaaaaa aaaaaaaaaa   4380
aaaaaaaaaa aaaaaaaaaa aaaaaaaaaa aaaaaaaaaa aaaaaaaaaa aaaaaaaaaa   4440
aaaaaaaaaa aaaaaaaaaa aaaaaaaaaa aaaaaaaaaa aaaaaaaaaa aaaaaaaaaa   4500
aaaaaaaaaa aaaaaaaaaa aaaaaaaaaa aaaaaaaaaa aaaaaaaaaa aaaaaaaaaa   4560
aaaaaaaaaa aaaaaaaaaa aaaaaaaaaa aaaaaaaaaa aaaaaaaaaa aaaaaaaaaa   4620
aaaaaaaaaa aaaaaaaaaa aaaaaaaaaa aaaaaaaaaa aaaaaaaaaa aaaaaaaaaa   4680
aaaaaaaaaa aaaaaaaaaa aaaaaaaaaa aaaaaaaaaa aaaaaaaaaa aaaaaaaaaa   4740
aaaaaaaaaa aaaaaaaaaa aaaaaaaaaa aaaaaaaaaa aaaaaaaaaa aaaaaaaaaa   4800
aaaaaaaaaa aaaaaaaaaa aaaaaaaaaa aaaaaaaaaa aaaaaaaaaa aaaaaaaaaa   4860
aaaaaaaaaa aaaaaaaaaa aaaaaaaaaa aaaaaaaaaa aaaaaaaaaa aaaaaaaaaa   4920
aaaaaaaaaa aaaaaaaaaa aaaaaaaaaa aaaaaaaaaa aaaaaaaaaa aaaaaaaaaa   4980
aaaaaaaaaa aaaaaaaaaa                                               5000

PolyA
                                                       (SEQ ID NO: 34)
aaaaaaaaaa aaaaaaaaaa aaaaaaaaaa aaaaaaaaaa aaaaaaaaaa aaaaaaaaaa     60
aaaaaaaaaa aaaaaaaaaa aaaaaaaaaa aaaaaaaaaa aaaaaaaaaa aaaaaaaaaa    120
aaaaaaaaaa aaaaaaaaaa aaaaaaaaaa aaaaaaaaaa aaaaaaaaaa aaaaaaaaaa    180
aaaaaaaaaa aaaaaaaaaa aaaaaaaaaa aaaaaaaaaa aaaaaaaaaa aaaaaaaaaa    240
aaaaaaaaaa aaaaaaaaaa aaaaaaaaaa aaaaaaaaaa aaaaaaaaaa aaaaaaaaaa    300
aaaaaaaaaa aaaaaaaaaa aaaaaaaaaa aaaaaaaaaa aaaaaaaaaa aaaaaaaaaa    360
aaaaaaaaaa aaaaaaaaaa aaaaaaaaaa aaaaaaaaaa                          400

PolyA
                                                       (SEQ ID NO: 35)
aaaaaaaaaa aaaaaaaaaa aaaaaaaaaa aaaaaaaaaa aaaaaaaaaa aaaaaaaaaa     60
aaaaaaaaaa aaaaaaaaaa aaaaaaaaaa aaaaaaaaaa aaaaaaaaaa aaaaaaaaaa    120
aaaaaaaaaa aaaaaaaaaa aaaaaaaaaa aaaaaaaaaa aaaaaaaaaa aaaaaaaaaa    180
aaaaaaaaaa aaaaaaaaaa aaaaaaaaaa aaaaaaaaaa aaaaaaaaaa aaaaaaaaaa    240
aaaaaaaaaa aaaaaaaaaa aaaaaaaaaa aaaaaaaaaa aaaaaaaaaa aaaaaaaaaa    300
aaaaaaaaaa aaaaaaaaaa aaaaaaaaaa aaaaaaaaaa aaaaaaaaaa aaaaaaaaaa    360
aaaaaaaaaa aaaaaaaaaa aaaaaaaaaa aaaaaaaaaa aaaaaaaaaa aaaaaaaaaa    420
aaaaaaaaaa aaaaaaaaaa aaaaaaaaaa aaaaaaaaaa aaaaaaaaaa aaaaaaaaaa    480
aaaaaaaaaa aaaaaaaaaa aaaaaaaaaa aaaaaaaaaa aaaaaaaaaa aaaaaaaaaa    540
aaaaaaaaaa aaaaaaaaaa aaaaaaaaaa aaaaaaaaaa aaaaaaaaaa aaaaaaaaaa    600
aaaaaaaaaa aaaaaaaaaa aaaaaaaaaa aaaaaaaaaa aaaaaaaaaa aaaaaaaaaa    660
aaaaaaaaaa aaaaaaaaaa aaaaaaaaaa aaaaaaaaaa aaaaaaaaaa aaaaaaaaaa    720
aaaaaaaaaa aaaaaaaaaa aaaaaaaaaa aaaaaaaaaa aaaaaaaaaa aaaaaaaaaa    780
aaaaaaaaaa aaaaaaaaaa aaaaaaaaaa aaaaaaaaaa aaaaaaaaaa aaaaaaaaaa    840
aaaaaaaaaa aaaaaaaaaa aaaaaaaaaa aaaaaaaaaa aaaaaaaaaa aaaaaaaaaa    900
aaaaaaaaaa aaaaaaaaaa aaaaaaaaaa aaaaaaaaaa aaaaaaaaaa aaaaaaaaaa    960
aaaaaaaaaa aaaaaaaaaa aaaaaaaaaa aaaaaaaaaa aaaaaaaaaa aaaaaaaaaa   1020
aaaaaaaaaa aaaaaaaaaa aaaaaaaaaa aaaaaaaaaa aaaaaaaaaa aaaaaaaaaa   1080
aaaaaaaaaa aaaaaaaaaa aaaaaaaaaa aaaaaaaaaa aaaaaaaaaa aaaaaaaaaa   1140
```

-continued

```
aaaaaaaaaa aaaaaaaaaa aaaaaaaaaa aaaaaaaaaa aaaaaaaaaa aaaaaaaaaa   1200
aaaaaaaaaa aaaaaaaaaa aaaaaaaaaa aaaaaaaaaa aaaaaaaaaa aaaaaaaaaa   1260
aaaaaaaaaa aaaaaaaaaa aaaaaaaaaa aaaaaaaaaa aaaaaaaaaa aaaaaaaaaa   1320
aaaaaaaaaa aaaaaaaaaa aaaaaaaaaa aaaaaaaaaa aaaaaaaaaa aaaaaaaaaa   1380
aaaaaaaaaa aaaaaaaaaa aaaaaaaaaa aaaaaaaaaa aaaaaaaaaa aaaaaaaaaa   1440
aaaaaaaaaa aaaaaaaaaa aaaaaaaaaa aaaaaaaaaa aaaaaaaaaa aaaaaaaaaa   1500
aaaaaaaaaa aaaaaaaaaa aaaaaaaaaa aaaaaaaaaa aaaaaaaaaa aaaaaaaaaa   1560
aaaaaaaaaa aaaaaaaaaa aaaaaaaaaa aaaaaaaaaa aaaaaaaaaa aaaaaaaaaa   1620
aaaaaaaaaa aaaaaaaaaa aaaaaaaaaa aaaaaaaaaa aaaaaaaaaa aaaaaaaaaa   1680
aaaaaaaaaa aaaaaaaaaa aaaaaaaaaa aaaaaaaaaa aaaaaaaaaa aaaaaaaaaa   1740
aaaaaaaaaa aaaaaaaaaa aaaaaaaaaa aaaaaaaaaa aaaaaaaaaa aaaaaaaaaa   1800
aaaaaaaaaa aaaaaaaaaa aaaaaaaaaa aaaaaaaaaa aaaaaaaaaa aaaaaaaaaa   1860
aaaaaaaaaa aaaaaaaaaa aaaaaaaaaa aaaaaaaaaa aaaaaaaaaa aaaaaaaaaa   1920
aaaaaaaaaa aaaaaaaaaa aaaaaaaaaa aaaaaaaaaa aaaaaaaaaa aaaaaaaaaa   1980
aaaaaaaaaa aaaaaaaaaa                                                2000
```

Gly/Ser (SEQ ID NO: 38): This sequence may encompass 1-10
"Gly Gly Gly Ser" repeating units
GGGSGGGSGG GSGGGSGGGS GGGSGGGSGG GSGGGSGGGS Exemplary CD19 CAR constructs that can be used in the methods described herein are shown in Table 4:

TABLE 4

CD19 CAR Constructs

| Name | SEQ ID | Sequence |
|---|---|---|
| CAR 1 | | |
| CAR1 scFv domain | 39 | EIVMTQSPATLSLSPGERATLSCRASQDISKYLNWYQQKPGQAPRLLIYHT SRLHSGIPARFSGSGSGTDYTLTISSLQPEDFAVYFCQQGNTLPYTFGQGT KLEIKGGGGSGGGGSGGGGSQVQLQESGPGLVKPSETLSLTCTVSGVSLPD YGVSWIRQPPGKGLEWIGVIWGSETTYYSSSLKSRVTISKDNSKNQVSLKL SSVTAADTAVYYCAKHYYYGGSYAMDYWGQGTLVTVSS |
| 103101 CAR1 Soluble scFv - nt | 52 | atggccctccctgtcaccgccctgctgcttccgctggctcttctgctccacgccgc tcggcccgaaattgtgatgacccagtcacccgccactcttagcctttcaccggtg agcgcgcaaccctgtcttgcagagcctcccaagacatctcaaaataccttaattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccggcggtggaggaagccaggtccaactccaagaaa gcggaccgggtcttgtgaagccatcagaaactctttcactgacttgtactgtgagc ggagtgtctctccccgattacggggtgtcttggatcagacagccaccggggaaggg tctggaatggattggagtgatttgggggctctgagactacttactactcttcatccc tcaagtcacgcgtcaccatctcaaaggacaactctaagaatcaggtgtcactgaaa ctgtcatctgtgaccgcagccgacaccgccgtgtactattgcgctaagcattacta ttatggcgggagctacgcaatggattactggggacagggtactctggtcaccgtgt ccagccaccaccatcatcaccatcaccat |
| 103101 CAR1 Soluble seFv- aa | 64 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsqvqlqesgpglvkpsetlsltctvs gvslpdygvswirqppgkglewigviwgsettyyssslksrvtiskdnsknqvslk lssvtaadtavyycakhyyyggsyamdywgqgtivtvss<u>hhhhhhhh</u> |
| 104875 CAR 1 - Full - nt | 90 | atggccctccctgtcaccgccctgctgcttccgctggctcttctgctccacgccgc tcggcccgaaattgtgatgacccagtcacccgccactcttagcctttcaccggtg agcgcgcaaccctgtcttgcagagcctcccaagacatctcaaaataccttaattgg tatcaacagaagcccggacaggctcctcgccttctgatctaccacaccagccggct ccattctggaatccctgccaggttcagcggtagcggatctgggaccgactacaccc |

TABLE 4-continued

CD19 CAR Constructs

| Name | SEQ ID | Sequence |
|---|---|---|
| | | tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttgggctctgagactacttactactcttcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactgggacagggtactctggtcaccgtgt<br>ccagcaccactaccccagcaccgaggccacccacccccggctcctaccatcgcctcc<br>cagcctctgtccctgcgtccggaggcatgtagacccgcagctggtggggccgtgca<br>tacccggggtcttgacttcgcctgcgatatctacatttgggccctctggctggta<br>cttgcgggtcctgctgctttcactcgtgatcactctttactgtaagcgcggtcgg<br>aagaagctgctgtacatctttaagcaaccttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaac<br>cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaaggggaacgcagaagaggcaaaggccacgacggactgtaccagggact<br>cagcaccgccaccaaggacacctatgacgctcttcacatgcaggccctgccgcctc<br>gg |
| 104875<br>CAR 1 -<br>Full - aa | 77 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtklkleikgggggsggggsggggsqvqlqesgpglvkpsetlsltctvs<br>gvslpdygvswirqppgkglewigviwgsettyyssslksrvtiskdnsknqvslk<br>lssvtaadtavyycakhyyyggsyamdywgqgtivtvssttttpaprpptpaptias<br>qplslrpeacrpaaggavhtrgldfacdiyiwaplagtcgvlllslvitlyckrgr<br>kkllyifkqpfmrpvqttqeedgcscrfpeeeeggcelrvkfsrsadapaykqgqn<br>qlynelnlgrreeydvldkrrgrdpemggkprrknpqeglynelqkdkmaeaysei<br>gmkgerrrgkghdglyqglstatkdtydalhmqalppr |

CAR 2

| Name | SEQ ID | Sequence |
|---|---|---|
| CARL2 scFv<br>domain | 40 | eivmtqspatlslspgeratlscrasqdiskylnwyqqkpgqaprlliyhtsrlhs<br>giparfsgsgsgtdytltisslqpedfavyfcqqgntlpytfgqgtkleikgggs<br>ggggsggggsqvqlqesgpglvkpsetlsltctvsgvslpdygvswirqppgkgle<br>wigviwgsettyyqsslksrvtiskdnsknqvslklssvtaadtavyycakhyyyg<br>gsyamdywgqgtlvtvss |
| 103102<br>CAR2-<br>Soluble<br>scFv - nt | 53 | atggccctccctgtcaccgccctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaaatacccttaattgg<br>tatcaacagaaagcccggacaggctcctcgccttctgatctaccacaccagccggct<br>ccattctggaatcccctgccaggttcagcggtagcggatctgggaccgactacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttgggctctgagactacttactaccaatcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactgggacagggtactctggtcaccgtgt<br>ccagcaccaccatcatcaccatcaccat |
| 103102<br>CAR2-<br>Soluble<br>scFv - aa | 65 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikgggsggggsggggsqvqlqesgpglvkpsetlsltctvs<br>gvslpdygvswirqppgkglewigviwgsettyyqsslksrvtiskdnsknqvslk<br>lssvtaadtavyycakhyyyggsyamdywgqgtlvtvsshhhhhhhh |
| 104876<br>CAR 2 -<br>Full - nt | 91 | atggccctccctgtcaccgccctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaaatacccttaattgg<br>tatcaacagaaagcccggacaggctcctcgccttctgatctaccacaccagccggct<br>ccattctggaatcccctgccaggttcagcggtagcggatctgggaccgactacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttgggctctgagactacttactaccaatcatccc<br>tcaagtcacgcgtcaccatctcaaaggacaactctaagaatcaggtgtcactgaaa<br>ctgtcatctgtgaccgcagccgacaccgccgtgtactattgcgctaagcattacta |

TABLE 4-continued

CD19 CAR Constructs

| Name | SEQ ID | Sequence |
|---|---|---|
| | | ttatggcgggagctacgcaatggattactggggacagggtactctggtcaccgtgt |
| | | ccagcaccactacccagcaccgaggccaccaccccggctcctaccatcgcctcc |
| | | cagcctctgtccctgcgtccggaggcatgtagacccgcagctggtggggccgtgca |
| | | tacccggggtcttgacttcgcctgcgatatctacatttgggcccctctggctggta |
| | | cttgcgggtcctgctgctttcactcgtgatcactctttactgtaagcgcggtcgg |
| | | aagaagctgctgtacatctttaagcaaccttcatgaggcctgtgcagactactca |
| | | agaggaggacggctgttcatgccggttcccagaggaggaggaaggcggctgcgaac |
| | | tgcgcgtgaaattcagccgcagcgcagatgctccagcctacaagcaggggcagaac |
| | | cagctctacaacgaactcaatcttggtcggagaggagttacgacgtgctggacaa |
| | | gcggagaggacgggacccagaaatgggcgggaagccgcgcagaaagaatccccaag |
| | | agggcctgtacaacgagctccaaaaggataagatggcagaagcctatagcgagatt |
| | | ggtatgaaaggggaacgcagaagaggcaaaggccacgacggactgtaccagggact |
| | | cagcaccgccaccaaggacacctatgacgctcttcacatgcaggccctgccgcctc |
| | | gg |
| 104876 CAR 2 - Full - aa | 78 | MALPVTALLLPLALLLHAARPeivmtqspatlslspgeratlscrasgdiskylnw yqqkpgqaprlliyhtsrlhsgiparfsgsgsgtdytltisslqpedfavyfcggg ntlpytfgqgtkleikggggsggggsggggsqvqlqesgpglvkpsetlsltctvs gyslpdygvswirqppgkglewigviwgsettyyqsslksrvtiskdnsknqvslk lssvtaadtavyycakhyyyggsyamdywgqgtlvtvssttttpaprpptpaptias qplslrpeacrpaaggavhtrgldfacdiyiwaplagtcgvlllslvitlyckrgr kkllyifkqpfmrpvqttqeedgcscrfpeeeeggcelrvkfsrsadapaykqgqn qlynelnlgrreeydvldkrrgrdpemggkprrknpqeglynelqkdkmaeaysei gmkgerrrgkghdglyqglstatkdtydalhmqalppr |

CAR 3

| Name | SEQ ID | Sequence |
|---|---|---|
| CAR3 scFv domain | 41 | qvqlqesgpglvkpsetlsltctvsgvslpdygvswirqppgkglewigviwgset tyyssslksrvtiskdnsknqvslklssvtaadtavyycakhyyyggsyamdywgq gtlvtvssggggsggggsggggseivmtqspatlslspgeratlscrasqdiskyl nwyqqkpgqaprlliyhtsrlhsgiparfsgsgsgtdytltisslqpedfavyfcq qgntlpytfgqgtkleik |
| 103104 CAR 3 - Soluble scFv - nt | 54 | atggctctgcccgtgaccgcactcctcctgccactggctctgctgcttcacgccgc tcgcccacaagtccagcttcaagaatcagggcctggtctggtgaagccatctgaga ctctgtccctcacttgcaccgtgagcggagtgtcctcccagactacggagtgagc tggattagacagcctcccggaaagggactggagtggatcggagtgatttggggtag cgaaaccacttactattcatctttcctgaagtcacgggtcaccattcaaaggata actcaaagaatcaagtgagcctcaagctctcatcagtcaccgccgctgacaccgcc gtgtattactgtgccaagcattactactatggagggtcctacgccatggactactg gggccagggaactctggtcactgtgtcatctggtggaggaggtagcggaggaggcg ggagcggtggaggtggctccgaaatcgtgatgacccagagccctgcaaccctgtcc ctttctcccggggaacgggctacccttcttgtcgggcatcacaagatatctcaaa ataccctcaattggtatcaacagaagccgggacaggcccctaggcttcttatctacc acacctctcgcctgcatagcgggattcccgcacgctttagcgggtctggaagcggg accgactacactctgaccatctcatctctccagcccgaggacttcgccgtctactt ctgccagcagggtaacaccctgccgtacaccttcggccagggcaccaagcttgaga tcaaacatcaccaccatcatcaccatcac |
| 103104 CAR 3 - Soluble scFv - aa | 66 | MALPVTALLLPLALLLHAARPqvqlqesgpglvkpsetlsltctvsgvslpdygvs wirqppgkglewigviwgsettyysslksrvtiskdnsknqvslklssvtaadta vyycakhyyyggsyamdywgqgtlvtvssggggsggggsggggseivmtqspatls lspgeratlscrasqdiskylnwyqqkpgqaprlliyhtsrlhsgiparfsgsgsg tdytltisslqpedfavyfcqqgntlpytfgqgtkleikhhhhhhhh |
| 104877 CAR 3 - Full - nt | 92 | atggctctgcccgtgaccgcactcctcctgccactggctctgctgcttcacgccgc tcgcccacaagtccagcttcaagaatcagggcctggtctggtgaagccatctgaga ctctgtccctcacttgcaccgtgagcggagtgtcctcccagactacggagtgagc tggattagacagcctcccggaaagggactggagtggatcggagtgatttggggtag cgaaaccacttactattcatctttcctgaagtcacgggtcaccattcaaaggata actcaaagaatcaagtgagcctcaagctctcatcagtcaccgccgctgacaccgcc gtgtattactgtgccaagcattactactatggagggtcctacgccatggactactg gggccagggaactctggtcactgtgtcatctggtggaggaggtagcggaggaggcg ggagcggtggaggtggctccgaaatcgtgatgacccagagccctgcaaccctgtcc ctttctcccggggaacgggctacccttcttgtcgggcatcacaagatatctcaaa ataccctcaattggtatcaacagaagccgggacaggcccctaggcttcttatctacc acacctctcgcctgcatagcgggattcccgcacgctttagcgggtctggaagcggg accgactacactctgaccatctcatctctccagcccgaggacttcgccgtctactt ctgccagcagggtaacaccctgccgtacaccttcggccagggcaccaagcttgaga tcaaaccactactcccgctccaaggccaccaccctgccccgaccatcgcctct cagccgcttccctgcgtccggaggcatgtagacccgcagctggtggggccgtgca tacccggggtcttgacttcgcctgcgatatctacatttgggcccctctggctggta cttgcggggtcctgctgctttcactcgtgatcactctttactgtaagcgcggtcgg aagaagctgctgtacatctttaagcaaccttcatgaggcctgtgcagactactca agaggaggacggctgttcatgccggttcccagaggaggaggaaggcggctgcgaac tgcgcgtgaaattcagccgcagcgcagatgctccagcctacaagcaggggcagaac |

TABLE 4-continued

CD19 CAR Constructs

| Name | SEQ ID | Sequence |
|---|---|---|
| | | cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaaggggaacgcagaagaggcaaaggccacgacggactgtaccagggact<br>cagcaccgccaccaaggacacctatgacgctcttcacatgcaggccctgccgcctc<br>gg |
| 104877<br>CAR 3 -<br>Full - aa | 79 | MALPVTALLLPLALLLHAARPqvqlqesgpglvkpsetlsltctvsgvslpdygvs<br>wirqppgkglewigviwgsettyyssslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleikttttpaprppptpaptias<br>qplslrpeacrpaaggavhtrgldfacdiyiwaplagtcgvlllslvitlyckrgr<br>kkllyifkqpfmrpvqttqeedgcscrfpeeeeggcelrvkfsrsadapaykqgqn<br>qlynelnlgrreeydvldkrrgrdpemggkprrknpqeglynelqkdkmaeaysei<br>gmkgerrrgkghdglyqglstatkdtydalhmqalppr |

CAR 4

| Name | SEQ ID | Sequence |
|---|---|---|
| CAR4 scFv<br>domain | 42 | qvqlqesgpglvkpsetlsltctvsgvslpdygvswirqppgkglewigviwgset<br>tyyqsslksrvtiskdnsknqvslklssvtaadtavyycakhyyyggsyamdywgq<br>gtlvtvssggggsggggsggggseivmtqspatlslspgeratlscrasqdiskyl<br>nwyqqkpgqaprlliyhtsrlhsgiparfsgsgsgtdytltisslqpedfavyfcq<br>qgntlpytfgqgtkleik |
| 103106<br>CAR4 -<br>Soluble<br>scFv - nt | 55 | atggctctgcccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactatcaatctttccctgaagtcacgggtcaccattttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>ggagcggtggaggtggctccgaaatcgtgatgacccagagccctgcaaccctgtcc<br>ctttctcccggggaacgggctacccttcttgtcgggcatcacaagatatctcaaa<br>atacctcaattggtatcaacagaagccgggacaggcccctaggcttcttatctacc<br>acacctctcgcctgcatagcgggattcccgcacgctttagcgggtctggaagcggg<br>accgactacactctgaccatctcatctctccagcccgaggacttcgccgtctactt<br>ctgccagcagggtaacaccctgccgtacaccttcggccagggcaccaagcttgaga<br>tcaaacatcaccaccatcatcaccatcac |
| 103106<br>CAR4 -<br>Soluble<br>scFv -aa | 67 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleikhhhhhhhh |
| 104878<br>CAR 4 -<br>Full-nt | 93 | atggctctgcccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactatcaatctttccctgaagtcacgggtcaccattttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>ggagcggtggaggtggctccgaaatcgtgatgacccagagccctgcaaccctgtcc<br>ctttctcccggggaacgggctacccttcttgtcgggcatcacaagatatctcaaa<br>atacctcaattggtatcaacagaagccgggacaggcccctaggcttcttatctacc<br>acacctctcgcctgcatagcgggattcccgcacgctttagcgggtctggaagcggg<br>accgactacactctgaccatctcatctctccagcccgaggacttcgccgtctactt<br>ctgccagcagggtaacaccctgccgtacaccttcggccagggcaccaagcttgaga<br>tcaaaaccactactcccgctccaaggccacccaccctgccccgaccatcgcctct<br>cagccgctttcctgcgtccggaggcatgtagacccgcagctggtggggccgtgca<br>tacccggggtcttgacttcgcctgcgatatctacatttgggcccctctggctggta<br>cttgcggggtcctgctgcttcactcgtgatcactctttactgtaagcgcggtcgg<br>aagaagctgctgtacatcttttaagcaaccttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaac<br>cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaaggggaacgcagaagaggcaaaggccacgacggactgtaccagggact<br>cagcaccgccaccaaggacacctatgacgctcttcacatgcaggccctgccgcctc<br>gg |

TABLE 4-continued

| CD19 CAR Constructs | | |
|---|---|---|
| Name | SEQ ID | Sequence |
| 104878 CAR 4 - Full - aa | 80 | MALPVTALLLPLALLLHAARPqvqlqesgpglvkpsetlsltctvsgvslpdygvswirqppgkglewigviwgsettyygsslksrvtiskdnsknqvslklssvtaadtavyycakhyyyggsyamdywgqgtlvtvssggggsggggsggggseivmtqspatlslspgeratlscrasgdiskylnwyqqkpgqaprlliyhtsrlhsgiparfsgsgsgtdytltisslqpedfavyfcqqgntlpytfgqgtkleikttttpaprpptpaptiasqplslrpeacrpaaggavhtrgldfacdiyiwaplagtcgvlllslvitlyckrgrkkllyifkqpfmrpvqttgeedgcscrfpeeeeggcelrvkfsrsadapaykqgqnqlynelnlgrreeydvldkrrgrdpemggkprrknpqeglynelqkdkmaeayseigmkgerrrgkghdglyqglstatkdtydalhmqalppr |
| CAR 5 | | |
| CAR5 scFv domain | 43 | eivmtqspatlslspgeratlscrasqdiskylnwyqqkpgqaprlliyhtsrlhsgiparfsgsgsgtdytltisslqpedfavyfcqqgntlpytfgqgtkleikggggsggggsggggsggggsqvqlqesgpglvkpsetlsltctvsgvslpdygvswirqppgkglewigviwgsettyyssslksrvtiskdnsknqvslklssvtaadtavyycakhyyyggsyamdywgqgtlvtvss |
| 99789 CAR5 - Soluble scFv - nt | 56 | atggccctcccagtgaccgctctgctgctgcctctcgcacttcttctccatgccgctcggcctgagatcgtcatgacccaaagcccgctaccctgtccctgtcacccggcgagagggcaaccctttcatgcagggccagccaggacatttctaagtacctcaactggtatcagcagaagccaggcgaggtcctcgcctgctgatctaccacaccagccgcctccacagcggtatccccgcagattttcgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattgggtgatttggggatcagagactactactactcttcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggacccctggtgactgtctcagccatcaccatcaccaccatcatcac |
| 99789 CAR5 - Soluble scFv -aa | 68 | MALPVTALLLPLALLLHAARPeivmtqspatlslspgeratlscrasqdiskylnwyqqkpgqaprlliyhtsrlhsgiparfsgsgsgtdytltisslqpedfavyfcqqgntlpytfgqgtkleikggggsggggsggggsggggsqvqlqesgpglvkpsetlsltctvsgvslpdygvswirqppgkglewigviwgsettyyssslksrvtiskdnsknqvslklssvtaadtavyycakhyyyggsyamdywgqgtlvtvsshhhhhhhh |
| 104879 CAR 5 - Full - nt | 94 | atggccctccctgtcaccgccctgctgcttccgctggctcttctgctccacgccgctcggccccgaaattgtgatgacccagtcacccgccactcttagcctttcacccggtgagcgcgcaaccctgtcttgcagagcctcccaagacatctcaaatacctttaattggtatcaacagaagcccggacaggctcctcgccttctgatctaccacaccagccggctccattctggaatccctgccaggttcagcggtagcggatctgggaccgactacaccctcactatcagctcactgcagccagagacttcgctgtctatttctgtcagcaagggaacaccctgccctacacctttggacagggcaccaagctcgagattaaaggtggagtggcagcggaggaggtgggtccggcggtggaggaagcggcggaggcgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttgggctctgagactactactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactgggacagggtactctggtcaccgtgtccagcaccactaccccagcaccgaggccaccaccccggctcctaccatcgcctcccagcctctgtccctcgctccggaggcatgtagacccgcagctggtggggccgtgcatacccggggtcttgacttcgcctgcgatatctacatttgggccctctggctggtacttgcggggtcctgctgctttcactcgtgatcactctttactgtaagcgcggtcggaagaagctgctgtacatctttaagcaaccccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatcccccaagagggcctgtacaacagctccaaaaggataagatggcagaagcctatagcgagattggtatgaaagggaacgcagaagaggcaaaggccacgacggactgtaccagggactcagcaccgccaccaaggacacctatgacgctcttcacatgcaggccctgccgcctcgg |
| 104879 CAR 5 - Full - aa | 81 | MALPVTALLLPLALLLHAARPeivmtqspatlslspgeratlscrasgdiskylnwyqqkpgqaprlliyhtsrlhsgiparfsgsgsgtdytltisslqpedfavyfcqqgntlpytfgqgtkleikggggsggggsggggsggggsqvqlqesgpglvkpsetlsltctvsgvslpdygvswirqppgkglewigviwgsettyyssslksrvtiskdnsknqvslklssvtaadtavyycakhyyyggsyamdywgqgtlvtvsstttpaprpptpaptiasqplslrpeacrpaaggavhtrgldfacdiyiwaplagtcgvlllslvitlyckrgrkkllyifkqpfmrpvqttqeedgcscrfpeeeeggcelrvkfsrsadapay |

TABLE 4-continued

CD19 CAR Constructs

| Name | SEQ ID | Sequence |
|---|---|---|
| | | kqgqnqlynelnlgrreeydvldkrrgrdpemggkprrknpqeglynelqkdkmae ayseigmkgerrrgkghdglyqglstatkdtydalhmqalppr |

CAR 6

| Name | SEQ ID | Sequence |
|---|---|---|
| CAR6 scFv domain | 44 | eivmtqspatlslspgeratlscrasqdiskylnwyqqkpgqaprlliyhtsrlhs giparfsgsgsgtdytltisslqpedfavyfcqqgntlpytfgqgtkleikggggs ggggsggggsggggsqvqlqesgpglvkpsetlsltctvsgvslpdygvswirqpp gkglewigviwgsettyyqsslksrvtiskdnsknqvslklssvtaadtavyycak hyyyggsyamdywgqgtlvtvss |
| 99790 CAR6 - Soluble scFv - nt | 57 | atggccctcccagtgaccgctctgctgctgcctctcgcacttcttctccatgccgc tcggcctgagatcgtcatgacccaaagcccgcctaccctgtccctgtcacccggg agagggcaaccctttcatgcagggccagccaggacatttctaagtacctcaactgg tatcagcagaaagccagggcaggctcctcgcctgctgatctaccacaccagccgct ccacagcggtatccccgcagattttccgggagcgggtctggaaccgactacaccc tcaccatctcttctctgcagcccgaggatttcgccgtctatttctgccagcaggg aatactctgccgtacaccttcggtcaaggtaccaagctggaaatcaagggaggcgg aggatcaggcggtggcggaagcggaggaggtggctccggaggaggaggttcccaag tgcagcttcaagaatcaggacccggacttgtgaagccatcagaaaccctctccctg acttgtacctgtccggtgtgagcctccccgactacggagtctcttggattcgcca gcctccggggaagggtcttgaatggattggggtgatttgggga tcagagactactt actaccagtcatcacttaagtcacgggtcaccatcagcaaagataatagcaagaac caagtgtcacttaagctgtcatctgtgaccgccgctgacaccgccgtgtactattg tgccaaacattactattacggagggtcttatgctatggactactggggacagggga ccctggtgactgtctctagccatcaccatcaccaccatcatcac |
| 99790 CAR6 - Soluble scFv - aa | 69 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsggggsqvqlqesgpglvkpsetlsl tctvsgvslpdygvswirqppgkglewigviwgsettyyqsslksrvtiskdnskn qvslklssvtaadtavyycakhyyyggsyamdywgqgtlvtvsshhhhhhhh |
| 104880 CAR6 - Full - nt | 95 | atggccctccctgtcaccgccctgctgcttccgctggctcttctgctccacgccgc tcggcccgaaattgtgatgacccagtcacccgccactcttagcctttcacccggtg agcgcgcaaccctgtcttgcagagcctcccaagacatctcaaaatacctta attgg tatcaacagaaacccggacaggctcctcgccttctgatctaccacaccagccggct ccattctgaaatccctgccaggttcagcggtagcggatctggaaccgactacaccc tcactatcagctcactgcagccagaggacttcgctgtctatttctgtcagcaaggg aacaccctgccctacaccttggacagggcaccaagctcgagattaaaggtggagg tggcagcggaggaggtgggtccggcggtggaggaagcggaggcggaggggagccagg tccaactccaagaaagcgaccgggtcttgtgaagccatcagaaactctttcactg acttgtactgtgagcggagtgtctctccccgattacggggtgtcttggatcagaca gccaccggggaagggtctggaatggattggagtgatttggggctctgagactactt actaccaatcatccctcaagtcacgcgtcaccatctcaaaggacaactctaagaat caggtgtcactgaaactgtcatctgtgaccgcagccgacaccgccgtgtactattg cgctaagcattactattatggcgggagctacgcaatggattactggggacagggta ctctggtcaccgtgtccagcaccactaccccagcaccgaggccacccaccccggct cctaccatcgcctcccagcctctgtccctgcgtccggaggcatgtagacccgcagc tggtgggccgtgcataccggggtcatttgacttcgcctgcgatatctacatttggg ccccctctggctggtacttgcggggtcctgctgcttttcactcgtgatcactctttac tgtaagcgcggtcggaagaagctgctgtacatctttaagcaacccttcatgaggcc tgtgcagactactcaagaggaggacggctgttcatgccggttcccagaggaggagg aaggcggctgcgaactgcgcgtgaaattcagccgcagcgcagatgctccagcctac aagcagggcagaaccagctctacaacgaactcaatcttggtcggagagaggagta cgacgtgctggacaagcggagaggacgggacccagaaatgggcgggaagccgcgca gaaagaatccccaagagggcctgtacaacgagctccaaaaggataagatggcagaa gcctatagcgagattggtatgaaaggggaacgcagaagaggcaaaggccacgacgg actgtaccagggactcagcaccgccaccaaggacacctatgacgctcttcacatgc aggccctgccgcctcgg |
| 104880 CAR6 - Full - aa | 82 | MALPVTALLLPLALLLHAARPeivmtqspatlslspgeratlscrasqdiskylnww yqqkpgqaprlliyhtsrlhsgiparfsgsgsgtdytltisslqpedfavyfcqqg ntlpytfgqgtkleikggggsggggsggggsggggsqvqlqesgpglvkpsetlsl tctvsgvslpdygvswirqppgkglewigviwgsettyyqsslksrvtiskdnskn qvslklssvtaadtavyycakhyyyggsyamdywgqgtlvtvsstttpaprpptpa ptiasqplslrpeacrpaaggavhtrgldfacdiyiwaplagtcgvlllslvitly ckrgrkkllyifkqpfmrpvqttqeedgcscrfpeeeeggcelrvkfsrsadapay kqgqnqlynelnlgrreeydvldkrrgrdpemggkprrknpqeglynelqkdkmae ayseigmkgerrrgkghdglyqglstatkdtydalhmqalppr |

CAR 7

| Name | SEQ ID | Sequence |
|---|---|---|
| CAR7 scFv domain | 45 | qvqlqesgpglvkpsetlsltctvsgvslpdygvswirqppgkglewigviwgset tyyssslksrvtiskdnsknqvslklssvtaadtavyycakhyyyggsyamdywgq gtlvtvssggggsggggsggggsggggseivmtqspatlslspgeratlscrasqd |

TABLE 4-continued

CD19 CAR Constructs

| Name | SEQ ID | Sequence |
|---|---|---|
| | | iskylnwyqqkpgqaprlliyhtsrlhsgiparfsgsgsgtdytltisslqpedfa
vyfcqqgntlpytfgqgtkleik |
| 100796
CAR7 -
Soluble
scFv - nt | 58 | atggcactgcctgtcactgccctcctgctgcctctggcctcttctgcatgccgc
caggcccaagtccagctgcaagagtcaggacccggactggtgaagccgtctgaga
ctctctcactgacttgtaccgtcagcggcgtgtccctcccgactacggagtgtca
tggatccgccaacctcccgggaaaggggcttgaatggattggtgtcatctggggttc
tgaaaccacctactactcatcttccctgaagtccaggggtgaccatcagcaaggata
attccaagaaccaggtcagccttaagctgtcatctgtgaccgctgctgacaccgcc
gtgtattactgcgccaagcactactattacggaggaagctacgcctatggactattg
gggacagggcactctcgtgactgtgagcagcggcggtgagggtctggaggtggag
gatccggtggtggtgggtcaggcggaggagggagcgagattgtgatgactcagtca
ccagccaccctttctctttcaccgggcgagagagcaaccctgagctgtagagccag
ccaggacatttctaagtacctcaactggtatcagcaaaaaccggggcaggcccctc
gcctcctgatctaccatacctcacgccttcactctggtatccccgctcggtttagc
ggatcaggatctggtaccgactacactctgaccatttccagcctgcagccagaaga
tttcgcagtgtatttctgccagcagggcaataccctccttctacaccttcggtcagg
gaaccaagctcgaaatcaagcaccatcaccatcatcaccaccat |
| 100796
CAR7 -
Soluble
scFv - aa | 70 | MALPVTALLLPLALLLHAARPqvqlqesgpglvkpsetlsltctvsgvslpdygvs
wirqppgkglewigviwgsettyyssslksrvtiskdnsknqvslklssvtaadta
vyycakhyyyggsyamdywgqgtlvtvssggggsggggsggggsggggseivmtqs
patlslspgeratlscrasqdiskylnwyqqkpgqaprlliyhtsrlhsgiparfs
gsgsgtdytltisslqpedfavyfcqqgntlpytfgqgtkleikhhhhhhhh |
| 104881
CAR 7
Full - nt | 96 | atggctctgccgtgaccgcactcctcctgccactggctctgctgcttcacgccgc
tcgcccacaagtccagcttcaagaatcagggcctggtctggtgaagccatctgaga
ctctgtccctcacttgcaccgtgagcggagtgtccctcccagactacggagtgagc
tggattagacagcctcccggaaagggactggagtggatcggagtgatttgggtag
cgaaaccacttactattcatcttccctgaagtcacgggtcaccattttcaaaggata
actcaaagaatcaagtgagcctcaagctctcatcagtcaccgccgctgacaccgcc
gtgtattactgtgccaagcattactactatggagggtcctacgccatggactactg
gggccagggaactctggtcactgtgtcatctggtggaggaggtagcggaggaggcg
ggagcggtggaggtggctccggaggtggcggaagcgaaatcgtgatgacccagagc
cctgcaaccctgtccctttctcccggggaacgggctaccctttcttgtcgggcatc
acaagatatctcaaaatacctcaattggtatcaacagaagccgggacaggcccta
ggcttcttatctaccacacctctcgcctgcatagcgggattcccgcacgctttagc
gggtctggaagcgggaccgactacactctgaccatctcatctctccagcccgagga
cttcgcgtctacttctgccagcagggtaacaccctgccgtacaccttcggccagg
gcaccaagcttgagatcaaaaccactactcccgctccaaggccaccacccctgcc
ccgaccatcgcctctcagccgctttcctgcgtccgaggcatgtagacccgcagc
tggtggggccgtgcataccggggtcttgacttcgcctgcgatatctcacatttggg
cccctctggctggtacttgcgggtcctgctgctttcactcgtgatcactctttac
tgtaagcgcggtcggaagaagctgctgtacatcttaagcaaccttcatgaggcc
tgtgcagactactcaagaggaggacggctgttcatgccggttcccagaggaggagg
aaggcggctgcgaactgcgcgtgaaattcagccgcagcgagatgctccagcctac
aagcaggggcagaaccagctctacaacgaactcaatcttggtcggagagaggagta
cgacgtgctggacaagcggagaggacgggacccagaaatgggcgggaagccgcgca
gaaagaatccccaagagggcctgtacaacgagctccaaaaggataagatggcagaa
gcctatagcgagattggtatgaaggggaacgcagaagaggcaaaggccacgacgg
actgtaccagggactcagcaccgccaccaaggacacctatgacgctcttcacatgc
aggccctgccgcctcgg |
| 104881
CAR 7
Full - aa | 83 | MALPVTALLLPLALLLHAARPqvqlqesgpglvkpsetlsltctvsgvslpdygvs
wirqppgkglewigviwgsettyyssslksrvtiskdnsknqvslklssvtaadta
vyycakhyyyggsyamdywgqgtlvtvssggggsggggsggggsggggseivmtqs
patlslspgeratlscrasqdiskylnwyqqkpgqaprlliyhtsrlhsgiparfs
gsgsgtdytltisslqpedfavyfcqqgntlpytfgqgtkleiktttpaprpptpa
ptiasqplslrpeacrpaaggavhtrgldfacdiyiwaplagtcgvlllslvitly
ckrgrkklllyifkqpfmrpvqttqeedgcscrfpeeeeggcelrvkfsrsadapay
kqgqnqlynelnlgrreeydvldkrrgrdpemggkprrknpqeglynelqkdkmae
ayseigmkgerrrgkghdglyqglstatkdtydalhmqalppr |
| | CAR 8 | |
| CAR8 scFv
domain | 46 | qvqlqesgpglvkpsetlsltctvsgvslpdygvswirqppgkglewigviwgset
tyyqsslksrvtiskdnsknqvslklssvtaadtavyycakhyyyggsyamdywgq
gtlvtvssggggsggggsggggsggggseivmtqspatlslspgeratlscrasqd
iskylnwyqqkpgqaprlliyhtsrlhsgiparfsgsgsgtdytltisslqpedfa
vyfcqqgntlpytfgqgtkleik |
| 100798
CAR8 -
Soluble
scFv - nt | 59 | atggcactgcctgtcactgccctcctgctgcctctggcctcttctgcatgccgc
caggcccaagtccagctgcaagagtcaggacccggactggtgaagccgtctgaga
ctctctcactgacttgtaccgtcagcggcgtgtccctcccgactacggagtgtca
tggatccgccaacctcccgggaaaggggcttgaatggattggtgtcatctggggttc
tgaaaccacctactaccagtcttccctgaagtccaggggtgaccatcagcaaggata |

TABLE 4-continued

| | | CD19 CAR Constructs |
|---|---|---|
| Name | SEQ ID | Sequence |
| | | attccaagaaccaggtcagccttaagctgtcatctgtgaccgctgctgacaccgcc<br>gtgtattactgcgccaagcactactattacggaggaagctacgcatggactattg<br>gggacagggcactctcgtgactgtgagcagcggcggtggagggtctggaggtggag<br>gatccggtggtggtgggtcaggcggaggagggagcgagattgtgatgactcagtca<br>ccagccaccctttctcttcaccgggcgagagagcaaccctgagctgtagagccag<br>ccaggacatttctaagtacctcaactggtatcagcaaaaaccggggcaggcccctc<br>gcctcctgatctaccatacctcacgccttcactctggtatccccgctcggtttagc<br>ggatcaggatctggtaccgactacactctgaccatttccagcctgcagccagaaga<br>tttcgcagtgtatttctgccagcagggcaatacccttcctacaccttcggtcagg<br>gaaccaagctcgaaatcaagcaccatcaccatcatcatcaccac |
| 100798<br>CAR8 -<br>Soluble<br>scFv - aa | 71 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleikhhhhhhhh |
| 104882<br>CAR 8 -<br>Full - nt | 97 | atggctctgcccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttgggggtag<br>cgaaaccacttactatcaatcttccctgaagtcacgggtcaccatttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>ggagcggtggaggtggctccggaggcggtgggtcagaaatcgtgatgacccagagc<br>cctgcaaccctgtccctttctcccggggaacgggctaccctttcttgtcgggcatc<br>acaagatatctcaaaatacctcaattggtatcaacagaagccgggacaggccccta<br>ggcttcttatctaccacacctctcgcctgcatagcgggattcccgcacgctttagc<br>gggtctggaagcgggaccgactacactctgaccatctcatctctccagcccgagga<br>cttcgccgtctacttctgccagcagggtaacaccctgccgtacaccttcggccagg<br>gcaccaagcttgagatcaaaaccactactcccgctccaaggccaccccacccctgcc<br>ccgaccatcgcctctcagccgcttttccctgcgtccgaggcatgtagacccgcagc<br>tggtggggccgtgcataccggggtcttgacttcgcctgcgatatctacatttggg<br>cccctctggctggtacttgcggggtcctgctgctttcactcgtgatcactctttac<br>tgtaagcgcggtcggaagaagctgctgtacatctttaagcaaccccttcatgaggcc<br>tgtgcagactactcaagaggaggacggctgttcatgccggttcccagaggaggagg<br>aaggcggctgcgaactgcgcgtgaaattcagccgcagcgagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 104882<br>CAR 8 -<br>Full - aa | 84 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleiktttpaprpptpa<br>ptiasqplslrpeacrpaaggavhtrgldfacdiyiwaplagtcgvlllslvitly<br>ckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |

CAR 9

| CAR9 scFv<br>domain | 47 | eivmtqspatlslspgeratlscrasqdiskylnwyqqkpgqaprlliyhtsrlhs<br>giparfsgsgsgtdytltisslqpedfavyfcqqgntlpytfgqgtkleikgggs<br>ggggsggggsggggsqvqlqesgpglvkpsetlsltctvsgvslpdygvswirqpp<br>gkglewigviwgsettyynsslksrvtiskdnsknqvslklssvtaadtavyycak<br>hyyyggsyamdywgqgtlvtvss |
| 99789<br>CAR9 -<br>Soluble<br>scFv - nt | 60 | atggccctcccagtgaccgctctgctgctgcctctcgcacttcttctccatgccgc<br>tcggcctgagatcgtcatgacccaaagccccgctaccctgtccctgtcaccggcg<br>agagggcaaccctttcatgcagggccagccaggacatttctaagtacctcaactgg<br>tatcagcagaaagcagggcaggcctcctcgcctgctgatctaccacaccagccgct<br>ccacagcggtatccccgccagattttccgggagcgggtctggaaccgactacaccc<br>tcaccatctcttctgcagcccgagatttcgccgtctatttctgccagcagggg<br>aatactctgccgtacaccttcggtcaaggtaccaagctggaaatcaagggaggcgg<br>aggatcaggcggtggcgaagcggaggaggtggctccggaggaggaggttcccaag<br>tgcagcttcaagaatcaggacccggacttgtgaagccatcagaaaccctctccctg<br>acttgtaccgtgtccggtgtgagcctccccgactacggagtctcttggattcgcca<br>gcctccggggaagggtcttgaatggattgggtgatttggggatcagagactactt<br>actacaattcatcacttaagtcacgggtcaccatcagcaaagataatagcaagaac<br>caagtgtcacttaagctgtcatctgtgaccgccgctgacaccgccgtgtactattg |

TABLE 4-continued

CD19 CAR Constructs

| Name | SEQ ID | Sequence |
|---|---|---|
| | | tgccaaacattactattacggagggtcttatgctatggactactggggacagggga ccctggtgactgtctctagccatcaccatcaccaccatcatcac |
| 99789 CAR9 - Soluble scFv - aa | 72 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikgggggsggggsggggsggggsqvqlqesgpglvkpsetlsl tctvsgvslpdygvswirqppgkglewigviwgsettyynsslksrvtiskdnskn qvslklssvtaadtavyycakhyyyggsyamdywgqgtlvtvsshhhhhhhh |
| 105974 CAR 9 - Full - nt | 98 | atggccctccctgtcaccgccctgctgcttccgctggctcttctgctccacgccgc tcggcccgaaattgtgatgacccagtcacccgccactcttagcctttcaccggtg agcgcgcaaccctgtcttgcagagcctcccaagacatctcaaaataccttaattgg tatcaacagaaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccggcggtggaggaagcggaggcggtggggagccagg tccaactccaagaaagcggaccgggtcttgtgaagccatcagaaactctttcactg acttgtactgtgagcggagtgtctctccccgattacggggtgtcttggatcagaca gccaccggggaagggtctggaatggattggagtgatttgggctctgagactactt actacaactcatccctcaagtcacgcgtcaccatctcaaaggacaactctaagaat caggtgtcactgaaactgtcatctgtgaccgcagccgacaccgccgtgtactattg cgctaagcattactattatggcgggagctacgcaatggattactggggacagggta ctctggtcaccgtgtccagcaccactacccagcaccgaggccacccaccccggct cctaccatcgcctcccagcctctgtccctgcgtccggaggcatgtagacccgcagc tggtggggccgtgcatacccgggtcttgacttcgcctgcgatatctacatttggg ccctctggctggtacttgcgggtcctgctgctttcactcgtgatcactctttac tgtaagcgcggtcggaagaagctgctgtacatctttaagcaaccttcatgaggcc tgtgcagactactcaagaggaggacggctgttcatgccggttcccagaggaggagg aaggcggctgcgaactgcgcgtgaaattcagccgcagcgcagatgctccagcctac aagcaggggcagaaccagctctacaacgaactcaatcttggtcggagagaggagta cgacgtgctggacaagcggagaggacgggacccagaaatgggcgggaagccgcgca gaaagaatccccaagagggcctgtacaacagctccaaaaggataagatggcagaa gcctatagcgagattggtatgaaggggaacgcagaagaggcaaaggccacgacgg actgtaccagggactgcaccgccaccaaggacacctatgacgctcttcacatgc aggccctgccgcctcgg |
| 105974 CAR 9 - Full - aa | 85 | MALPVTALLLPLALLLHAARPeivmtqspatlslspgeratlscrasqdiskylnwyqqkpgqaprlliyhtsrlhsgiparfsgsgsgtdytltisslqpedfavyfcqqg ntlpytfgqgtkleikgggggsggggsggggsggggsqvqlqesgpglvkpsetlsl tctvsgvslpdygvswirqppgkglewigviwgsettyynsslksrvtiskdnsks qvslklssvtaadtavyycakhyyyggsyamdywgqgtlvtvsstttpaprpptpa ptiasqplslrpeacrpaaggavhtrgldfacdiyiwaplagtcgvlllslvitly ckrgrkkllyifkqpfmrpvqttqeedgcscrfpeeeeggcelrvkfsrsadapay kqgqnqlynelnlgrreeydvldkrrgrdpemggkprrknpqeglynelqkdkmae ayseigmkgerrrgkghdglyqglstatkdtydalhmqalppr |

CAR 10

| CAR10 scFv domain | 48 | qvqlqesgpglvkpsetlsltctvsgvslpdygvswirqppgkglewigviwgset tyynsslksrvtiskdnsknqvslklssvtaadtavyycakhyyyggsyamdywgq gtlvtvssggggsggggsggggsggggseivmtqspatlslspgeratlscrasqd iskylnwyqqkpgqaprlliyhtsrlhsgiparfsgsgsgtdytltisslqpedfa vyfcqqgntlpytfgqgtkleik |
| 100796 CAR10 - Soluble scFv - nt | 61 | atggcactgcctgtcactgccctcctgctgcctctggccctccttctgcatgccgc caggcccccaagtccagctgcaagagtcaggacccggactggtgaagccgtctgaga ctctctcactgacttgtaccgtcagcggcgtgtccctcccgactacggagtgtca tggatccgccaacctcccgggaaagggcttgaatggattggtgtcactgggggttc tgaaaccacctactacaactcttccctgaagtccagggtgaccatcagcaaggata attccaagaaccaggtcagccttaagctgtcatctgtgaccgctgctgacaccgcc gtgtattactgcgccaagcactactattacggagaagctacgctatggactattg gggacagggcactctcgtgactgtgagcagcggcggtgaggtctgaggtggag gatccggtggtggtgggtcaggcggaggagggagcgagattgtgatgactcagtca ccagccacccttctctttcaccggcgagagagcaaccctgagctgtagagcag ccaggacatttctaagtacctcaactggtatcagcaaaaaccggggcaggcccctc gcctcctgatctaccatacctcacgccttcactctggtatcccgctcggtttagc ggatcaggatctggtaccgactacactctgaccatttccagcctgcagccagaaga tttcgcagtgtatttctgccagcagggcaatacccttccttacaccttcggtcagg gaaccaagctcgaaatcaagcaccatcaccatcatcaccat |
| 100796 CAR10 - Soluble scFv - aa | 73 | MALPVTALLLPLALLLHAARPqvqlqesgpglvkpsetlsltctvsgvslpdygvs wirqppgkglewigviwgsettyynsslksrvtiskdnsknqvslklssvtaadta vyycakhyyyggsyamdywgqgtlvtvssggggsggggsggggsggggseivmtqs patlslspgeratlscrasqdiskylnwyqqkpgqaprlliyhtsrlhsgiparfs gsgsgtdytltisslqpedfavyfcqqgntlpytfgqgtkleikhhhhhhhh |

TABLE 4-continued

CD19 CAR Constructs

| Name | SEQ ID | Sequence |
|---|---|---|
| 105975 CAR 10 Full - nt | 99 | atggccctccctgtcaccgccctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaaatacttaattgg<br>tatcaacagaagcccggacaggctcctcgccttctgatctaccacaccagccggct<br>ccattctggaatccctgccaggttcagcggtagcggatctgggaccgactacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagcggaggcggtgggagccagg<br>tccaactccaagaaagcggacccgggtcttgtgaagccatcagaaactctttcactg<br>acttgtactgtgagcggagtgtctctccccgattacggggtgtcttggatcagaca<br>gccaccggggaagggtctggaatggattggagtgatttgggctctgagactactt<br>actacaactcatccctcaagtcacgcgtcaccatctcaaaggacaactctaagaat<br>caggtgtcactgaaactgtcatctgtgaccgcagccgacaccgccgtgtactattg<br>cgctaagcattactattatggcgggagctacgcaatggattactggggacagggta<br>ctctggtcaccgtgtccagccaccactaccccagcaccgaggccacccacccggct<br>cctaccatcgcctcccagcctctgtccctgcgtccggaggcatgtagacccgcagc<br>tggtggggccgtgcatacccgggtcttgacttcgcctgcgatatctacatttggg<br>cccctctggctggtacttgcggggtcctgctgctttcactcgtgatcactctttac<br>tgtaagcgcggtcggaagaagctgctgtacatcttaagcaaccttcatgaggcc<br>tgtgcagactactcaagaggaggacggctgttcatgccggttccagaggaggagg<br>aaggcggctgcgaactgcgcgtgaaattcagccgcagcgcagatgctccagcctac<br>aagcaggggcagaaccagctctacaacgaactcaatcttggtcggagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 105975 CAR 10 Full - aa | 86 | MALPVTALLLPLALLLHAARPEIVMTQSPATLSLSPGERATLSCRASQDISKYLNW YQQKPGQAPRLLIYHTSRLHSGIPARFSGSGSGTDYTLTISSLQPEDFAVYFCQQG NTLPYTFGQGTKLEIKGGGGSGGGGSGGGGSGGGGSQVQLQESGPGLVKPSETLSL TCTVSGVSLPDYGVSWIRQPPGKGLEWIGVIWGSETTYYNSSLKSRVTISKDNSKN QVSLKLSSVTAADTAVYYCAKHYYYGGSYAMDYWGQGTLVTVSSTTTPAPRPPTPA PTIASQPLSLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAE AYSEIGMKGERRRGKGHDGLYQGLSTATKDTYDALHMQALPPR |

CAR11

| | | |
|---|---|---|
| CAR11 scFv domain | 49 | eivmtqspatlslspgeratlscrasqdiskylnwyqqkpgqaprlliyhtsrlhs giparfsgsgsgtdytltisslqpedfavyfcqqgntlpytfgqgtkleikggggs ggggsggggsqvqlqesgpglvkpsetlsltctvsgvslpdygvswirqppgkgle wigviwgsettyynsslksrvtiskdnsknqvslklssvtaadtavyycakhyyyg gsyamdywgqgtlvtvss |
| 103101 CAR11 - Soluble scFv - nt | 62 | Atggccctccctgtcaccgccctgctgcttccgctggctcttctgctccacgccgc tcggcccgaaattgtgatgacccagtcacccgccactcttagcctttcacccggtg agcgcgcaaccctgtcttgcagagcctcccaagacatctcaaaatacttaattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccggcggtggaggaagcaggtccaactccaagaaa gcgaccgggtcttgtgaagccatcagaaactctttcactgacttgtactgtgagc ggagtgtctctccccgattacggggtgtcttggatcagacagccaccggggaaggg tctggaatggattggagtgatttgggctctgagactacttactacaattcatccc tcaagtcacgcgtcaccatctcaaaggacaactctaagaatcaggtgtcactgaaa ctgtcatctgtgaccgcagccgacaccgccgtgtactattgcgctaagcattacta ttatggcgggagctacgcaatggattactggggacagggtactctggtcaccgtgt ccagccaccaccatcatcaccatcaccat |
| 103101 CAR11 - Soluble scFv - aa | 74 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsqvqlqesgpglvkpsetlsltctvs gvslpdygvswirqppgkglewigviwgsettyynsslksrvtiskdnsknqvslk lssvtaadtavyycakhyyyggsyamdywgqgtlvtvsshhhhhhhh |
| 105976 CAR 11 Full - nt | 100 | atggctctgcccgtgaccgcactcctcctgccactggctctgctgcttcacgccgc tcgcccacaagtccagcttcaagaatcagggcctggtctggtgaagccatctgaga ctctgtccctcacttgcaccgtgagcggagtgtccctcccagactacggagtgagc tggattagacagcctcccggaaagggactggagtggatcggagtgatttggggtag cgaaacccttactataactcttccctgaagtcacgggtcaccatttcaaaggata actcaaagaatcaagtgagcctcaagctctcatcagtcaccgccgctgacaccgcc gtgtattactgtgccaagcattactactatggagggtcctacgccatggactactg |

TABLE 4-continued

CD19 CAR Constructs

| Name | SEQ ID | Sequence |
|---|---|---|
| | | gggccagggaactctggtcactgtgtcatctggtggaggaggtagcggaggaggcg<br>ggagcggtggaggtggctccggaggtggcggaagcgaaatcgtgatgacccagagc<br>cctgcaaccctgtccctttctcccggggaacgggctaccctttcttgtcgggcatc<br>acaagatatctcaaaatacctcaattggtatcaacagaagccgggacaggcccta<br>ggcttcttatctaccacacctctcgcctgcatagcgggattcccgcacgctttagc<br>gggtctggaagcgggaccgactacactctgaccatctcatctctccagcccgagga<br>cttcgccgtctacttctgccagcagggtaacaccctgccgtacaccttcggccagg<br>gcaccaagcttgagatcaaaaccactactcccgctccaaggccacccacccctgcc<br>ccgaccatcgcctctcagccgcttttccctgcgtccggaggcatgtgacccgcagc<br>tggtggggccgtgcatacccggggtcttgacttcgcctgcgatatctacatttggg<br>cccctctggctggtacttgcggggtcctgctgctttcactcgtgatcactctttac<br>tgtaagcgcggtcggaagaagctgctgtacatctttaagcaaccttcatgaggcc<br>tgtgcagactactcaagaggaggacggcgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 105976<br>CAR 11<br>Full - aa | 87 | MALPVTALLLPLALLLHAARPQVQLQESGPGLVKPSETLSLTCTVSGVSLPDYGVS<br>WIRQPPGKGLEWIGVIWGSETTYYNSSLKSRVTISKDNSKNQVSLKLSSVTAADTA<br>VYYCAKHYYYGGSYAMDYWGQGTLVTVSSGGGGSGGGGSGGGGSGGGGSEIVMTQS<br>PATLSLSPGERATLSCRASQDISKYLNWYQQKPGQAPRLLIYHTSRLHSGIPARFS<br>GSGSGTDYTLTISSLQPEDFAVYFCQQGNTLPYTFGQGTKLEIKTTTPAPRPPTPA<br>PTIASQPLSLRPEACRPAAGGAVHTRGLDFACDIYIWAPLAGTCGVLLLSLVITLY<br>CKRGRKKLLYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNELQKDKMAE<br>AYSEIGMKGERRRGKGHDGLYQGLSTATKDTYDALHMQALPPR |

CAR12

| CAR12<br>scFv<br>domain | 50 | qvqlqesgpglvkpsetlsltctvsgvslpdygvswirqppgkglewigviwgset<br>tyynsslksrvtiskdnsknqvslklssvtaadtavyycakhyyyggsyamdywgq<br>gtlvtvssggggsggggsggggseivmtqspatlslspgeratlscrasqdiskyl<br>nwyqqkpgqaprlliyhtsrlhsgiparfsgsgsgtdytltisslqpedfavyfcq<br>qgntlpytfgqgtkleik |
| 103104<br>CAR12 -<br>Soluble<br>scFv - nt | 63 | atggctctgccgtgaccgcactcctcctgccactggctctgctgcttcacgccgc<br>tcgcccacaagtccagcttcaagaatcagggcctggtctggtgaagccatctgaga<br>ctctgtccctcacttgcaccgtgagcggagtgtccctcccagactacggagtgagc<br>tggattagacagcctcccggaaagggactggagtggatcggagtgatttgggtag<br>cgaaaccacttactataactcttccctgaagtcacgggtcaccatttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>ggagcggtggaggtggctccgaaatcgtgatgacccagagccctgcaaccctgtcc<br>ctttctcccggggaacgggctaccctttcttgtcgggcatcacaagatatctcaaa<br>atacctcaattggtatcaacagaagccgggacaggcccctaggcttcttatctacc<br>acacctctcgcctgcatagcgggattcccgcacgctttagcgggtctggaagcggg<br>accgactacactctgaccatctcatctctccagcccgaggacttcgccgtctactt<br>ctgccagcagggtaacaccctgccgtacaccttcggccagggcaccaagcttgaga<br>tcaaacatcaccaccatcatcaccatcac |
| 103104<br>CAR12 -<br>Soluble<br>scFv -aa | 75 | MALPVTALLLPLALLLHAARPqvqlqesgpglvkpsetlsltctvsgvslpdygvs<br>wirqppgkglewigviwgsettyynsslksrvtiskdnsknqvslklssvtaadta<br>vyycakhyyyggsyamdywgqgtlvtvssggggsggggsggggseivmtqspatls<br>lspgeratlscrasqdiskylnwyqqkpgqaprlliyhtsrlhsgiparfsgsgsg<br>tdytltisslqpedfavyfcqqgntlpytfgqgtkleik<u>hhhhhhhh</u> |
| 105977<br>CAR 12 -<br>Full - nt | 101 | atggccctcccgtcaccgccctgctgcttccgctggctcttctgctccacgccgc<br>tcggcccgaaattgtgatgacccagtcacccgccactcttagcctttcacccgtg<br>agcgcgcaaccctgtcttgcagagcctcccaagacatctcaaaataccttaattgg<br>tatcaacgaagcccggacaggcctcgccttctgatctaccacaccagccggct<br>ccattctgaatccctgccaggttcagcggtagcggatctgggaccgactacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagccaggtccaactccaagaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttgggctctgagacttacttactacaactcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagcaccactaccccagcaccgaggccacccacccggctcctaccatcgcctcc |

TABLE 4-continued

CD19 CAR Constructs

| Name | SEQ ID | Sequence |
|---|---|---|
| | | cagcctctgtccctgcgtccggaggcatgtagacccgcagctggtggggccgtgca<br>tacccggggtcttgacttcgcctgcgatatctacatttgggcccctctggctggta<br>cttgcggggtcctgctgctttcactcgtgatcactctttactgtaagcgcggtcgg<br>aagaagctgctgtacatctttaagcaaccctttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaac<br>cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaagggaacgcagaagaggcaaaggccacgacggactgtaccagggact<br>cagcaccgccaccaaggacacctatgacgctcttcacatgcaggccctgccgcctc<br>gg |
| 105977<br>CAR 12 -<br>Full - aa | 88 | MALPVTALLLPLALLLHAARPEIVMTQSPATLSLSPGERATLSCRASQDISKYLNW<br>YQQKPGQAPRLLIYHTSRLHSGIPARFSGSGSGTDYTLTISSLQPEDFAVYFCQQG<br>NTLPYTFGQGTKLEIKGGGGSGGGGSGGGGSQVQLQESGPGLVKPSETLSLTCTVS<br>GVSLPDYGVSWIRQPPGKGLEWIGVIWGSETTYYNSSLKSRVTISKDNSKNQVSLK<br>LSSVTAADTAVYYCAKHYYYGGSYAMDYWGQGTLVTVSSTTTPAPRPPTPAPTIAS<br>QPLSLRPEACRPAAGGAVHTRGLDFACDIYIWAPLAGTCGVLLLSLVITLYCKRGR<br>KKLLYIFKQPFMRPVQTTQEEDGCSCRFPEEEEGGCELRVKFSRSADAPAYKQGQN<br>QLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |

CTL019

| Name | SEQ ID | Sequence |
|---|---|---|
| CTL019 -<br>Soluble<br>scFv-<br>Histag-<br>nt | 362 | atggccctgcccgtcaccgctctgctgctgcccttgctctgcttcttcatgcagc<br>aaggccggacatccagatgacccaaaccacctcatccctctctgcctctcttggag<br>acagggtgaccattcttgtcgcgccagccaggacatcagcaagtatctgaactgg<br>tatcagcagaagccggacggaaccgtgaagctcctgatctaccatacctctcgcct<br>gcatagcggcgtgccctcacgcttctctggaagcggatcaggaaccgattattctc<br>tcactatttcaaatcttgagcaggaagatattgccacctatttctgccagcaggt<br>aataccctgccctacaccttcggaggagggaccaagctcgaaatcaccggtggagg<br>aggcagcggcggtggagggtctggtggaggtggttctgaggtgaagctgcaagaat<br>caggccctggacttgtggccccttcacagtccctgagcgtgacttgcaccgtgtcc<br>ggagtctccctgccccgactacggagtgtcatggatcagacaacctccacggaaagg<br>actggaatggctcggtgtcatctgggtagcgaaactacttactacaattcagccc<br>tcaaaagcaggctgactattatcaaggacaacagcaagtcccaagtctttcttaag<br>atgaactcactccagactgacgacaccgcaatctactattgtgctaagcactacta<br>ctacggaggatcctacgctatggattactggggacaaggtacttccgtcactgtct<br>cttcacaccatcatcaccatcaccatcac |
| CTL019 -<br>Soluble<br>scFv-<br>Histag-<br>aa | 76 | MALPVTALLLPLALLLHAARPdiqmtqttsslsaslgdrvtiscrasqdiskylnw<br>yqqkpdgtvklliyhtsrlhsgvpsrfsgsgsgtdysltisnleqediatyfcqqg<br>ntlpytfgggtkleitggggsggggsggggsevklqesgpglvapsqslsvtctvs<br>gvslpdygvswirqpprkglewlgviwgsettyynsalksrltiikdnsksqvflk<br>mnslqtddtaiyycakhyyyggsyamdywgqgtsvtvsshhhhhhhh |
| CTL019<br>Full - nt | 102 | atggccttaccagtgaccgccttgctcctgccgctggccttgctgctccacgccgc<br>caggccggacatccagatgacacagactacatcctcccgtctgcctctctgggag<br>acagagtcaccatcagttgcagggcaagtcaggacattagtaaatatttaaattgg<br>tatcagcagaaaccagatggaactgttaaactcctgatctaccatacatcaagatt<br>acactcaggagtcccatcaaggttcagtggcagtgggtctggaacagattattctc<br>tcaccattagcaacctggagcaagaagatattgccacttacttttgccaacagggt<br>aatacgcttccgtacacgttcggaggggggaccaagctggagatcacaggtggcgg<br>tggctcgggcggtggtgggtcgggtggcggcggatctgaggtgaaactgcaggagt<br>caggacctggcctggtggcgccctcacagagcctgtccgtcacatgcactgtctca<br>ggggtctcattacccgactatggtgtaagctggattcgccagcctccacgaaaggg<br>tctggagtggctgggagtaatatgggggtagtgaaaccacatactataattcagctc<br>tcaaatccagactgaccatcatcaaggacaactccaagagccaagtttttcttaaaa<br>atgaacagtctgcaaactgatgacacagccatttactactgtgccaaacattatta<br>ctacggtggtagctatgctatggactactggggccaaggaacctcagtcaccgtct<br>cctcaaccacgacgccagcgccgcgaccaccaacaccggcgcccaccatcgcgtcg<br>cagcccctgtccctgcgcccagaggcgtgccggcagcggcggggggcgcagtgca<br>cacgaggggctggacttcgcctgtgatatctacatctgggcgcccttggccggga<br>cttgtggggtccttctcctgtcactggttatcacccttactgcaaacggggcaga<br>aagaaactcctgtatatattcaaacaaccatttatgagaccagtacaaactactca<br>agaggaagatggctgtagctgccgatttccagaagaagaagaaggaggatgtgaac<br>tgagagtgaagttcagcaggagcgcagacgcccccgcgtacaagcagggccagaac<br>cagctctataacgagctcaatctaggacgaagaggagtacgatgttttggacaa<br>gagacgtggccgggacccctgagatggggggaaagccgagaaggaagaaccctcagg<br>aaggcctgtacaatgaactgcagaaagataagatggcggaggcctacagtgagatt<br>gggatgaaaggcgagcgccggaggggcaaggggcacgatggcctttaccagggtct<br>cagtacagccaccaaggacacctacgacgcccttcacatgcaggccctgccccctc<br>gc |

TABLE 4-continued

CD19 CAR Constructs

| Name | SEQ ID | Sequence |
|---|---|---|
| CTL019 Full - aa | 89 | MALPVTALLLPLALLLHAARPdiqmtqttsslsaslgdrvtiscrasqdiskylnw yqqkpdgtvklliyhtsrlhsgvpsrfsgsgsgtdysltisnleqediatyfcqqg ntlpytfgggtkleitggggsggggsggggsevklqesgpglvapsqslsvtctvs gvslpdygvswirqpprkglewlgviwgsettyynsalksrltiikdnsksqvflk mnslqtddtaiyycakhyyyggsyamdywgqgtsvtvssttttpaprpptpaptias qplslrpeacrpaaggavhtrgldfacdiyiwaplagtcgvlllslvitlyckrgr kkllyifkqpfmrpvqttqeedgcscrfpeeeeggcelrvkfsrsadapaykqgqn qlynelnlgrreeydvldkrrgrdpemggkprrknpqeglynelqkdkmaeaysei gmkgerrrgkghdglyqglstatkdtydalhmqalppr |
| CTL019 scFv domain | 51 | diqmtqttsslsaslgdrvtiscrasqdiskylnwyqqkpdgtvklliyhtsrlhs gvpsrfsgsgsgtdysltisnleqediatyfcqqgntlpytfgggtkleitgggs ggggsggggsevklqesgpglvapsqslsvtctvsgvslpdygvswirqpprkgle wlgviwgsettyynsalksrltiikdnsksqvflkmnslqtddtaiyycakhyyyg gsyamdywgqgtsvtvss |

Exemplary anti-BCMA CAR constructs (e.g., amino acid and nucleic acid sequences of scFv domains and CAR molecules) that can be used in the methods described herein are shown in Table 11. The heavy chain HC CDRs (HC CDR1, HC CDR2, HC CDR3) and LC CDRs (LC CDR1, LC CDR2, LCCDR3) are underlined. The amino acid sequences variable heavy chain and variable light chain sequences for each scFv is also provided.

TABLE 11

Amino Acid and Nucleic Acid Sequences of the anti-BCMA scFv domains and anti-BCMA CAR molecules

| Name/ Description | SEQ ID NO: | Sequence |
|---|---|---|
| 139103 | | |
| 139103- aa ScFv domain | 140 | QVQLVESGGGLVQPGRSLRLSCAASGFTFSNYAMSWVRQAPGKGLGWVSGISRSGENTYYADSV KGRFTISRDNSKNTLYLQMNSLRDEDTAVYYCARSPAHYYGGMDVWGQGTTVTVSSASGGGGSG GRASGGGGSDIVLTQSPGTLSLSPGERATLSCRASQSISSSFLAWYQQKPGQAPRLLIYGASRR ATGIPDRFSGSGSGTDFTLTISRLEPEDSAVYYCQQYHSSPSWTFGQGTKLEIK |
| 139103- nt ScFv domain | 141 | CAAGTGCAACTCGTGGAATCTGGTGGAGGACTCGTGCAACCCGGAAGATCGCTTAGACTGTCGT GTGCCGCCAGCGGGTTCACTTTCTCGAACTACGCGATGTCCTGGGTCCGCCAGGCACCCGGAAA GGGACTCGGTTGGGTGTCCGGCATTTCCCGGTCCGGCGAAAATACCTACTACGCCGACTCCGTG AAGGGCCGCTTCACCATCTCAAGGGACAACAGCAAAAACACCCTGTACTTGCAAATGAACTCCC TGCGGGATGAAGATACAGCCGTGTACTATTGCGCCCGGTCGCCTGCCCATTACTACGGCGGAAT GGACGTCTGGGGACAGGGAACCACTGTGACTGTCAGCAGCGCGTCGGGTGGCGGCGGCTCAGGG GGTCGGGCCTCCGGGGGGGAGGGTCCGACATCGTGCTGACCCAGTCCCCGGGAACCCTGAGCC TGAGCCCGGGAGAGCGCGCGACCCTGTCATGCCGGGCATCCCAGAGCATTAGCTCCTCCTTTCT CGCCTGGTATCAGCAGAAGCCCGGACAGGCCCCGAGGCTGCTGATCTACGGCGCTAGCAGAAGG GCTACCGGAATCCCAGACCGGTTCTCCGGCTCCGGTTCCGGGACCGATTTCACCCTTACTATCT CGCGCCTGGAACCTGAGGACTCCGCCGTCTACTACTGCCAGCAGTACCACTCATCCCCGTCGTG GACGTTCGGACAGGGCACCAAGCTGGAGATTAAG |
| 139103- aa VH | 142 | QVQLVESGGGLVQPGRSLRLSCAASGFTFSNYAMSWVRQAPGKGLGWVSGISRSGENTYYADSV KGRFTISRDNSKNTLYLQMNSLRDEDTAVYYCARSPAHYYGGMDVWGQGTTVTVSS |
| 139103- aa VL | 143 | DIVLTQSPGTLSLSPGERATLSCRASQSISSSFLAWYQQKPGQAPRLLIYGASRRATGIPDRFS GSGSGTDFTLTISRLEPEDSAVYYCQQYHSSPSWTFGQGTKLEIK |
| 139103- aa Full CAR | 144 | MALPVTALLLPLALLLHAARPQVQLVESGGGLVQPGRSLRLSCAASGFTFSNYAMSWVRQAPGK GLGWVSGISRSGENTYYADSVKGRFTISRDNSKNTLYLQMNSLRDEDTAVYYCARSPAHYYGGM DVWGQGTTVTVSSASGGGGSGGRASGGGGSDIVLTQSPGTLSLSPGERATLSCRASQSISSSFL AWYQQKPGQAPRLLIYGASRRATGIPDRFSGSGSGTDFTLTISRLEPEDSAVYYCQQYHSSPSW TFGQGTKLEIKTTTPAPRPPTPAPTIASQPLSLRPEACRPAAGGAVHTRGLDFACDIYIWAPLA GTCGVLLLSLVITLYCKRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNPQEGLYNELQKDKMAEA YSEIGMKGERRRGKHDGLYQGLSTATKDTYDALHMQALPPR |
| 139103- nt Full CAR | 145 | ATGGCCCTCCCTGTCACCGCCCTGCTGCTTCCGCTGGCTCTTCTGCTCCACGCCGCTCGGCCCC AAGTGCAACTCGTGGAATCTGGTGGAGGACTCGTGCAACCCGGAAGATCGCTTAGACTGTCGT GTGCCGCCAGCGGGTTCACTTTCTCGAACTACGCGATGTCCTGGGTCCGCCAGGCACCCGGAAAG GACTCGGTTGGGTGTCCGGCATTTCCCGGTCCGGCGAAAATACCTACTACGCCGACTCCGTGA AGGGCCGCTTCACCATCTCAAGGGACAACAGCAAAAACACCCTGTACTTGCAAATGAACTCCCT GCGGGATGAAGATACAGCCGTGTACTATTGCGCCCGGTCGCCTGCCCATTACTACGGCGGAATG GACGTCTGGGGACAGGGAACCACTGTGACTGTCAGCAGCGCGTCGGGTGGCGGCGGCTCAGGGG |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | GTCGGGCCTCCGGGGGGGAGGGTCCGACATCGTGCTGACCCAGTCCCCGGGAACCCTGAGCCT<br>GAGCCCGGGAGAGCGCGCGACCCTGTCATGCCGGGCATCCCAGAGCATTAGCTCCTCCTTTCTC<br>GCCTGGTATCAGCAGAAGCCCGGACAGGCCCCGAGGCTGCTGATCTACGGCGCTAGCAGAAGGG<br>CTACCGGAATCCCAGACCGGTTCTCCGGCTCCGGTTCCGGGACCGATTTCACCCTTACTATCTC<br>GCGCCTGGAACCTGAGGACTCCGCCGTCTACTACTGCCAGCAGTACCACTCATCCCCGTCGTGG<br>ACGTTCGGACAGGGCACCAAGCTGGAGATTAAGACCACTACCCCAGCACCGAGGCCACCCACCC<br>CGGCTCCTACCATCGCCTCCCAGCCTCTGTCCCTGCGTCCGGAGGCATGTAGACCCGCAGCTGG<br>TGGGGCCGTGCATACCCGGGGTCTTGACTTCGCCTGCGATATCTACATTTGGGCCCCTCTGGCT<br>GGTACTTGCGGGGTCCTGCTGCTTTCACTCGTGATCACTCTTTACTGTAAGCGCGGTCGGAAGA<br>AGCTGCTGTACATCTTTAAGCAACCCTTCATGAGGCCTGTGCAGACTACTCAAGAGGAGGACGG<br>CTGTTCATGCCGGTTCCCAGAGGAGGAGGAAGGCGGCTGCGAACTGCGCGTGAAATTCAGCCGC<br>AGCGCAGATGCTCCAGCCTACAAGCAGGGGCAGAACCAGCTCTACAACGAACTCAATCTTGGTC<br>GGAGAGAGGAGTACGACGTGCTGGACAAGCGGAGAGGACGGGACCCAGAAATGGGCGGGAAGCC<br>GCGCAGAAAGAATCCCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGACGGACTGTACCAGG<br>GACTCAGCACCGCCACCAAGGACACCTATGACGCTCTTCACATGCAGGCCCTGCCGCCTCGG |

139105

| 139105- aa<br>ScFv domain | 146 | QVQLVESGGGLVQPGRSLRLSCAASGFTFDDYAMHWVRQAPGKGLEWVSGISWNSGSIGYADSV<br>KGRFTISRDNAKNSLYLQMNSLRAEDTALYYCSVHSFLAYWGQGTLVTVSSASGGGGSGGRASG<br>GGGSDIVMTQTPLSLPVTPGEPASISCRSSQSLLHSNGYNYLDWYLQKPGQSPQLLIYLGSNRA<br>SGVPDRFSGSGSGTDFTLKISRVEAEDVGVYYCMQALQTPYTFGQGTKVEIK |
| 139105- nt<br>ScFv domain | 147 | CAAGTGCAACTCGTCGAATCCGGTGGAGGTCTGGTCCAACCTGGTAGAAGCCTGAGACTGTCGT<br>GTGCGGCCAGCGGATTCACCTTTGATGACTATGCTATGCACTGGGTGCGGCAGGCCCCAGGAAA<br>GGGCCTGGAATGGGTGTCGGGAATTAGCTGGAACTCCGGGTCCATTGGCTACGCCGACTCCGTG<br>AAGGGCCGCTTCACCATCTCCCGCGACAACGCAAAGAACTCCCTGTACTTGCAAATGAACTCGC<br>TCAGGGCTGAGGATACCGCGCTGTACTACTGCTCCGTGCATTCCTTCCTGGCCTACTGGGGACA<br>GGGAACTCTGGTCACCGTGTCGAGCGCCTCCGGCGGCGGGGGCTCGGGTGGACGGGCCTCGGGC<br>GGAGGGGGTCCGACATCGTGATGACCCAGACCCCGCTGAGCTTGCCCGTGACTCCCGGAGAGC<br>CTGCATCCATCTCCTGCCGGTCATCCCAGTCCCTTCTCCACTCCAACGGATACAACTACCTCGA<br>CTGGTACCTCCAGAAGCCGGGACAGAGCCCTCAGCTTCTGATCTACCTGGGGTCAAATAGAGCC<br>TCAGGAGTGCCGGATCGGTTCAGCGGATCTGGTTCGGGAACTGATTTCACTCTGAAGATTTCCC<br>GCGTGGAAGCCGAGGACGTGGGCGTCTACTACTGTATGCAGGCGCTGCAGACCCCCTATACCTT<br>CGGCCAAGGGACGAAAGTGGAGATCAAG |
| 139105- aa<br>VH | 148 | QVQLVESGGGLVQPGRSLRLSCAASGFTFDDYAMHWVRQAPGKGLEWVSGISWNSGSIGYADSV<br>KGRFTISRDNAKNSLYLQMNSLRAEDTALYYCSVHSFLAYWGQGTLVTVSS |
| 139105- aa<br>VL | 149 | DIVMTQTPLSLPVTPGEPASISCRSSQSLLHSNGYNYLDWYLQKPGQSPQLLIYLGSNRASGVP<br>DRFSGSGSGTDFTLKISRVEAEDVGVYYCMQALQTPYTFGQGTKVEIK |
| 139105- aa<br>Full CAR | 150 | MALPVTALLLPLALLLHAARPQVQLVESGGGLVQPGRSLRLSCAASGFTFDDYAMHWVRQAPGK<br>GLEWVSGISWNSGSIGYADSVKGRFTISRDNAKNSLYLQMNSLRAEDTALYYCSVHSFLAYWGQ<br>GTLVTVSSASGGGGSGGRASGGGGSDIVMTQTPLSLPVTPGEPASISCRSSQSLLHSNGYNYLD<br>WYLQKPGQSPQLLIYLGSNRASGVPDRFSGSGSGTDFTLKISRVEAEDVGVYYCMQALQTPYTF<br>GQGTKVEIKTTTPAPRPPTPAPTIASQPLSLRPEACRPAAGGAVHTRGLDFACDIYIWAPLAGT<br>CGVLLLSLVITLYCKRGRKKLLYIFKQPFMRPVQTTQEEDGCSCRFPEEEEGGCELRVKFSRSA<br>DAPAYKQGQNQLYNELNLGRREEYDVLDKRRGRDPEMGGKPRRKNPQEGLYNELQKDKMAEAYS<br>EIGMKGERRRGKGHDGLYQGLSTATKDTYDALHMQALPPR |
| 139105- nt<br>Full CAR | 151 | ATGGCCCTCCCTGTCACCGCCCTGCTGCTTCCGCTGGCTCTTCTGCTCCACGCCGCTCGGCCCC<br>AAGTGCAACTCGTCGAATCCGGTGGAGGTCTGGTCCAACCTGGTAGAAGCCTGAGACTGTCGT<br>GTGCGGCCAGCGGATTCACCTTTGATGACTATGCTATGCACTGGGTGCGGCAGGCCCCAGGAAA<br>GGGCCTGGAATGGGTGTCGGGAATTAGCTGGAACTCCGGGTCCATTGGCTACGCCGACTCCGTG<br>AAGGGCCGCTTCACCATCTCCCGCGACAACGCAAAGAACTCCCTGTACTTGCAAATGAACTCGC<br>TCAGGGCTGAGGATACCGCGCTGTACTACTGCTCCGTGCATTCCTTCCTGGCCTACTGGGGACA<br>GGGAACTCTGGTCACCGTGTCGAGCGCCTCCGGCGGCGGGGGCTCGGGTGGACGGGCCTCGGGCG<br>GAGGGGGTCCGACATCGTGATGACCCAGACCCCGCTGAGCTTGCCCGTGACTCCCGGAGAGCC<br>TGCATCCATCTCCTGCCGGTCATCCCAGTCCCTTCTCCACTCCAACGGATACAACTACCTCGAC<br>TGGTACCTCCAGAAGCCGGGACAGAGCCCTCAGCTTCTGATCTACCTGGGGTCAAATAGAGCCT<br>CAGGAGTGCCGGATCGGTTCAGCGGATCTGGTTCGGGAACTGATTTCACTCTGAAGATTTCCCG<br>CGTGGAAGCCGAGGACGTGGGCGTCTACTACTGTATGCAGGCGCTGCAGACCCCCTATACCTTC<br>GGCCAAGGGACGAAAGTGGAGATCAAGACCACTACCCCAGCACCGAGGCCACCCACCCCGGCTC<br>CTACCATCGCCTCCCAGCCTCTGTCCCTGCGTCCGGAGGCATGTAGACCCGCAGCTGGTGGGGC<br>CGTGCATACCCGGGGTCTTGACTTCGCCTGCGATATCTACATTTGGGCCCCTCTGGCTGGTACT<br>TGCGGGGTCCTGCTGCTTTCACTCGTGATCACTCTTTACTGTAAGCGCGGTCGGAAGAAGCTGC<br>TGTACATCTTTAAGCAACCCTTCATGAGGCCTGTGCAGACTACTCAAGAGGAGGACGGCTGTTC<br>ATGCCGGTTCCCAGAGGAGGAGGAAGGCGGCTGCGAACTGCGCGTGAAATTCAGCCGCAGCGCA<br>GATGCTCCAGCCTACAAGCAGGGGCAGAACCAGCTCTACAACGAACTCAATCTTGGTCGGAGAG<br>AGGAGTACGACGTGCTGGACAAGCGGAGAGGACGGGACCCAGAAATGGGCGGGAAGCCGCGCAG<br>AAAGAATCCCCAAGAGGGCCTGTACAACGAGCTCCAAAAGGATAAGATGGCAGAAGCCTATAGC |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | GAGATTGGTATGAAAGGGGAACGCAGAAGAGGCAAAGGCCACGACGGACTGTACCAGGGACTCA<br>GCACCGCCACCAAGGACACCTATGACGCTCTTCACATGCAGGCCCTGCCGCCTCGG |

139111

| 139111- aa<br>ScFv domain | 152 | EVQLLESGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSSASGGGGSGGGRASG<br>GGGSDIVMTQTPLSLSVTPGQPASISCKSSQSLLRNDGKTPLYWYLQKAGQPPQLLIYEVSNRF<br>SGVPDRFSGSGSGTDFTLKISRVEAEDVGAYYCMQNIQFPSFGGGTKLEIK |
| 139111- nt<br>ScFv domain | 153 | GAAGTGCAATTGTTGGAATCTGGAGGAGGACTTGTGCAGCCTGGAGGATCACTGAGACTTTCGT<br>GTGCGGTGTCAGGCTTCGCCCTGAGCAACCACGGCATGAGCTGGGTGCGGAGAGCCCCGGGGAA<br>GGGTCTGGAATGGGTGTCCGGGATCGTCTACTCCGGTTCAACTTACTACGCCGCAAGCGTGAAG<br>GTCGCTTCACCATTTCCCGCGATAACTCCCGGAACACCCTGTACCTCCAAATGAACTCCCTGC<br>GGCCCGAGGACACCGCCATCTACTACTGTTCCGCGCATGGAGGAGAGTCCGATGTCTGGGGACA<br>GGGCACTACCGTGACCGTGTCGAGCGCCTCGGGGGAGGAGGCTCCGGCGGTCGCGCCTCCGGG<br>GGGGGTGGCAGCGACATTGTGATGACGCAGACTCCACTCTCGCTGTCCGTGACCCCGGGACAGC<br>CCGCGTCCATCTCGTGCAAGAGCTCCCAGAGCCTGCTGAGGAACGACGGAAAGACTCCTCTGTA<br>TTGGTACCTCCAGAAGGCTGGACAGCCCCCGCAACTGCTCATCTACGAAGTGTCAAATCGCTTC<br>TCCGGGGTGCCGGATCGGTTTTCCGGCTCGGGATCGGGCACCGACTTCACCCTGAAAATCTCCA<br>GGGTCGAGGCCGAGGACGTGGGAGCCTACTACTGCATGCAAAACATCCAGTTCCCTTCCTTCGG<br>CGGCGGCACAAAGCTGGAGATTAAG |
| 139111- aa<br>VH | 154 | EVQLLESGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSS |
| 139111- aa<br>VL | 155 | DIVMTQTPLSLSVTPGQPASISCKSSQSLLRNDGKTPLYWYLQKAGQPPQLLIYEVSNRFSGVP<br>DRFSGSGSGTDFTLKISRVEAEDVGAYYCMQNIQFPSFGGGTKLEIK |
| 139111- aa<br>Full CAR | 156 | MALPVTALLLPLALLLHAARPEVQLLESGGGLVQPGGSLRLSCAVSGFALSNHGMSWVRRAPGK<br>GLEWVSGIVYSGSTYYAASVKGRFTISRDNSRNTLYLQMNSLRPEDTAIYYCSAHGGESDVWGQ<br>GTTVTVSSASGGGGSGGGRASGGGGSDIVMTQTPLSLSVTPGQPASISCKSSQSLLRNDGKTPLY<br>WYLQKAGQPPQLLIYEVSNRFSGVPDRFSGSGSGTDFTLKISRVEAEDVGAYYCMQNIQFPSFG<br>GGTKLEIKTTTPAPRPPTPAPTIASQPLSLRPEACRPAAGGAVHTRGLDFACDIYIWAPLAGTC<br>GVLLLSLVITLYCKRGRKKLLYIFKQPFMRPVQTTQEEDGCSCRFPEEEEGGCELRVKFSRSAD<br>APAYKQGQNQLYNELNLGRREEYDVLDKRRGRDPEMGGKPRRKNPQEGLYNELQKDKMAEAYSE<br>IGMKGERRRGKGHDGLYQGLSTATKDTYDALHMQALPPR |
| 139111- nt<br>Full CAR | 157 | ATGGCCCTCCCTGTCACCGCCCTGCTGCTTCCGCTGGCTCTTCTGCTCCACGCCGCTCGGCCCG<br>AAGTGCAATTGTTGGAATCTGGAGGAGGACTTGTGCAGCCTGGAGGATCACTGAGACTTTCGTG<br>TGCGGTGTCAGGCTTCGCCCTGAGCAACCACGGCATGAGCTGGGTGCGGAGAGCCCCGGGGAAG<br>GGTCTGGAATGGGTGTCCGGGATCGTCTACTCCGGTTCAACTTACTACGCCGCAAGCGTGAAGG<br>GTCGCTTCACCATTTCCCGCGATAACTCCCGGAACACCCTGTACCTCCAAATGAACTCCCTGCG<br>GCCCGAGGACACCGCCATCTACTACTGTTCCGCGCATGGAGGAGAGTCCGATGTCTGGGGACAG<br>GGCACTACCGTGACCGTGTCGAGCGCCTCGGGGGAGGAGGCTCCGGCGGTCGCGCCTCCGGGG<br>GGGGTGGCAGCGACATTGTGATGACGCAGACTCCACTCTCGCTGTCCGTGACCCCGGGACAGCC<br>CGCGTCCATCTCGTGCAAGAGCTCCCAGAGCCTGCTGAGGAACGACGGAAAGACTCCTCTGTAT<br>TGGTACCTCCAGAAGGCTGGACAGCCCCCGCAACTGCTCATCTACGAAGTGTCAAATCGCTTCT<br>CCGGGGTGCCGGATCGGTTTTCCGGCTCGGGATCGGGCACCGACTTCACCCTGAAAATCTCCAG<br>GGTCGAGGCCGAGGACGTGGGAGCCTACTACTGCATGCAAAACATCCAGTTCCCTTCCTTCGGC<br>GGCGGCACAAAGCTGGAGATTAAGACCACTACCCCAGCACCGAGGCCACCCACCCCGGCTCCTA<br>CCATCGCCTCCCAGCCTCTGTCCCTGCGTCCGAGGCATGTAGACCCGCAGCTGGTGGGGCCGT<br>GCATACCCGGGTCTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGGAAGAAGCTGCTGT<br>ACATCTTTAAGCAACCCTTCATGAGGCCTGTGCAGACTACTCAAGAGGAGGACGGCTGTTCATG<br>CCGGTTCCCAGAGGAGGAGGAAGGCGGCTGCGAACTGCGCGTGAAATTCAGCCGCAGCGCAGAT<br>GCTCCAGCCTACAAGCAGGGGCAGAACCAGCTCTACAACGAACTCAATCTTGGTCGGAGAGAGG<br>AGTACGACGTGCTGGACAAGCGGAGGAGGACGGGACCCAGAAATGGGCGGGAAGCCGCGCAGAAA<br>GAATCCCCAAGAGGGCCTGTACAACGAGCTCCAAAAGGATAAGATGGCAGAAGCCTATAGCGAG<br>ATTGGTATGAAAGGGGAACGCAGAAGAGGCAAAGGCCACGACGGACTGTACCAGGGACTCAGCA<br>CCGCCACCAAGGACACCTATGACGCTCTTCACATGCAGGCCCTGCCGCCTCGG |

139100

| 139100- aa<br>ScFv domain | 158 | QVQLVQSGAEVRKTGASVKVSCKASGYIFDNFGINWVRQAPGQGLEWMGWINPKNNNTNYAQKF<br>QGRVTITADESTNTAYMEVSSLRSEDTAVYYCARGPYYYQSYMDVWGQGTMVTVSSASGGGGSG<br>GRASGGGGSDIVMTQTPLSLPVTPGEPASISCRSSQSLLHSNGYNYLNWYLQKPGQSPQLLIYL<br>GSKRASGVPDRFSGSGSGTDFTLHITRVGAEDVGVYYCMQALQTPYTFGQGTKLEIK |
| 139100- nt<br>ScFv domain | 159 | CAAGTCCAACTCGTCCAGTCCGGCGCAGAAGTCAGAAAAACCGGTGCTAGCGTGAAAGTGTCCT<br>GCAAGGCCTCCGGCTACATTTTCGATAACTTCGGAATCAACTGGGTCAGACAGGCCCCCGGGCCA<br>GGGGCTGGAATGGATGGGATGGATCAACCCCAAGAACAACAACACCAACTACGCACAGAAGTTC<br>CAGGGCCGCGTGACTATCACCGCCGATGAATCGACCAATACCGCCTACATGGAGGTGTCCTCCC |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| | | TGCGGTCGGAGGACACTGCCGTGTATTACTGCGCGAGGGGCCCATACTACTACCAAAGCTACAT<br>GGACGTCTGGGGACAGGGAACCATGGTGACCGTGTCATCCGCCTCCGGTGGTGGAGGCTCCGGG<br>GGGCGGGCTTCAGGAGGCGGAGGAAGCGATATTGTGATGACCCAGACTCCGCTTAGCCTGCCCG<br>TGACTCCTGGAGAACCGGCCTCCATTTCCTGCCGGTCCTCGCAATCACTCCTGCATTCCAACGG<br>TTACAACTACCTGAATTGGTACCTCCAGAAGCCTGGCCAGTCGCCCCAGTTGCTGATCTATCTG<br>GGCTCGAAGCGCGCCTCCGGGGTGCCTGACCGGTTTAGCGGATCTGGGAGCGGCACGGACTTCA<br>CTCTCCACATCACCCGCGTGGGAGCGGAGGACGTGGGAGTGTACTACTGTATGCAGGCGCTGCA<br>GACTCCGTACACATTCGGACAGGGCACCAAGCTGGAGATCAAG |
| 139100- aa VH | 160 | QVQLVQSGAEVRKTGASVKVSCKASGYIFDNFGINWVRQAPGQGLEWMGWINPKNNNTNYAQKF<br>QGRVTITADESTNTAYMEVSSLRSEDTAVYYCARGPYYYQSYMDVWGQGTMVTVSS |
| 139100- aa VL | 161 | DIVMTQTPLSLPVTGEPASISCRSSQSLLHSNGYNYLNWYLQKPGQSPQLLIYLGSKRASGVP<br>DRFSGSGSGTDFTLHITRVGAEDVGVYYCMQALQTPYTFGQGTKLEIK |
| 139100- aa Full CAR | 162 | MALPVTALLLPLALLLHAARPQVQLVQSGAEVRKTGASVKVSCKASGYIFDNFGINWVRQAPGQ<br>GLEWMGWINPKNNNTNYAQKFQGRVTITADESTNTAYMEVSSLRSEDTAVYYCARGPYYYQSYM<br>DVWGQGTMVTVSSASGGGGSGGRASGGGGSDIVMTQTPLSLPVTGEPASISCRSSQSLLHSNG<br>YNYLNWYLQKPGQSPQLLIYLGSKRASGVPDRFSGSGSGTDFTLHITRVGAEDVGVYYCMQALQ<br>TPYTFGQGTKLEIKTTTPAPRPPTPAPTIASQPLSLRPEACRPAAGGAVHTRGLDFACDIYIWA<br>PLAGTCGVLLLSLVITLYCKRGRKKLLYIFKQPFMRPVQTTQEEDGCSCRFPEEEEGGCELRVK<br>FSRSADAPAYKQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |
| 139100- nt Full CAR | 163 | ATGGCCCTCCCTGTCACCGCCCTGCTGCTTCCGCTGGCTCTTCTGCTCCACGCCGCTCGGCCCC<br>AAGTCCAACTCGTCCAGTCCGGCGCAGAAGTCAGAAAAACCGGTGCTAGCGTGAAAGTGTCCTG<br>CAAGGCCTCCGGCTACATTTTCGATAACTTCGGAATCAACTGGGTCAGACAGGCCCCGGGCCAG<br>GGGCTGGAATGGATGGGATGGATCAACCCCAAGAACAACAACACCAACTACGCACAGAAGTTCC<br>AGGGCCGCGTGACTATCACCGCCGATGAATCGACCAATACCGCCTACATGGAGGTGTCCTCCCT<br>GCGGTCGGAGGACACTGCCGTGTATTACTGCGCGAGGGGCCCATACTACTACCAAAGCTACATG<br>GACGTCTGGGGACAGGGAACCATGGTGACCGTGTCATCCGCCTCCGGTGGTGGAGGCTCCGGG<br>GGCGGGCTTCAGGAGGCGGAGGAAGCGATATTGTGATGACCCAGACTCCGCTTAGCCTGCCCGT<br>GACTCCTGGAGAACCGGCCTCCATTTCCTGCCGGTCCTCGCAATCACTCCTGCATTCCAACGGT<br>TACAACTACCTGAATTGGTACCTCCAGAAGCCTGGCCAGTCGCCCCAGTTGCTGATCTATCTGG<br>GCTCGAAGCGCGCCTCCGGGGTGCCTGACCGGTTTAGCGGATCTGGGAGCGGCACGGACTTCAC<br>TCTCCACATCACCCGCGTGGGAGCGGAGGACGTGGGAGTGTACTACTGTATGCAGGCGCTGCAG<br>ACTCCGTACACATTCGGACAGGGCACCAAGCTGGAGATCAAGACCACTACCCCAGCACCGAGGC<br>CACCCACCCCGGCTCCTACCATCGCCTCCCAGCCTCTGTCCCTGCGTCGGAGGCATGTAGACC<br>CGCAGCTGGTGGGGCCGTGCATACCCGGGGTCTTGACTTCGCCTGCGATATCTACATTTGGGCC<br>CCTCTGGCTGGTACTTGCGGGGTCCTGCTGCTTTCACTCGTGATCACTCTTTACTGTAAGCGCG<br>GTCGGAAGAAGCTGCTGTACATCTTTAAGCAACCCTTCATGAGGCCTGTGCAGACTACTCAAGA<br>GGAGGACGGCTGTTCATGCCGGTTCCCAGAGGAGGAGGAAGGCGGCTGCGAACTGCGCGTGAAA<br>TTCAGCCGCAGCGCAGATGCTCCAGCTTACAAGCAGGGGCAGAACCAGCTCTACAACGAACTCA<br>ATCTTGGTCGGAGAGAGGAGTACGACGTGCTGGACAAGCGGAGAGGACGGGACCCAGAAATGGG<br>CGGGAAGCCGCGCAGAAAGAATCCCCAAGAGGGCCTGTACAACGAGCTCCAAAAGGATAAGATG<br>GCAGAAGCCTATAGCGAGATTGGTATGAAAGGGGAACGCAGAAGAGGCAAAGGCCACGACGGAC<br>TGTACCAGGGACTCAGCACCGCCACCAAGGACACCTATGACGCTCTTCACATGCAGGCCCTGCC<br>GCCTCGG |

139101

| 139101- aa ScFv domain | 164 | QVQLQESGGGLVQPGGSLRLSCAASGFTFSSDAMTWVRQAPGKGLEWVSVISGSGGTTYYADSV<br>KGRFTISRDNSKNTLYLQMNSLRAEDTAVYYCAKLDSSGYYYARGPRYWGQGTLVTVSSASGGG<br>GSGGGRASGGGGSDIQLTQSPSSLSASVGDRVTITCRASQSISSYLNWYQQKPGKAPKLLIYGAS<br>TLASGVPARFSGSGSGTHFTLTINSLQSEDSATYYCQQSYKRASFGQGTKVEIK |
| 139101- nt ScFv domain | 165 | CAAGTGCAACTTCAAGAATCAGGCGGAGGACTCGTGCAGCCCGGAGGATCATTGCGGCTCTCGT<br>GCGCCGCCTCGGGCTTCACCTTCTCGAGCGACGCCATGACCTGGGTCCGCCAGGCCCCGGGGAA<br>GGGGCTGGAATGGGTGTCTGTGATTTCCGGCTCCGGGGAACTACGTACTACGCCGATTCCGTG<br>AAAGGTCGCTTCACTATCTCCCGGGACAACAGCAAGAACACCCTTTATCTGCAAATGAATTCCC<br>TCCGCGCCGAGGACACCGCCGTGTACTACTGCGCCAAGCTGGACTCCTCGGGCTACTACTATGC<br>CCGGGGTCCGAGATACTGGGGACAGGGAACCCTCGTGACCGTGTCCTCCGCGTCCGGCGGAGGA<br>GGGTCGGGAGGCGGGCCTCCGGCGGCGGCGGTTCGGACATCCAGCTGACCCAGTCCCCATCCT<br>CACTGAGCGCAAGCGTGGGCGACAGAGTCACCATTACATGCAGGGCGTCCCAGAGCATCAGCTC<br>CTACCTGAACTGGTACCAACAGAAGCCTGGAAAGGCTCCTAAGCTGTTGATCTACGGGGCTTCG<br>ACCCTGGCATCCGGGGTGCCCGCGAGGTTCAGCGGAAGCGGTAGCGGCACTCACTTCACTCTGA<br>CCATTAACAGCCTCCAGTCCGAGGATTCAGCCACTTACTACTGTCAGCAGTCCTACAAGCGGGC<br>CAGCTTCGGACAGGGCACTAAGGTCGAGATCAAG |
| 139101- aa VH | 166 | QVQLQESGGGLVQPGGSLRLSCAASGFTFSSDAMTWVRQAPGKGLEWVSVISGSGGTTYYADSV<br>KGRFTISRDNSKNTLYLQMNSLRAEDTAVYYCAKLDSSGYYYARGPRYWGQGTLVTVSS |

TABLE 11-continued

Amino Acid and Nucleic Acid Sequences of the anti-BCMA scFv domains and anti-BCMA CAR molecules

| Name/ Description | SEQ ID NO: | Sequence |
|---|---|---|
| 139101- aa VL | 167 | DIQLTQSPSSLSASVGDRVTITCRASQSISSYLNWYQQKPGKAPKLLIYGASTLASGVPARFSG SGSGTHFTLTINSLQSEDSATYYCQQSYKRASFGQGTKVEIK |
| 139101- aa Full CAR | 168 | MALPVTALLLPLALLLHAARPQVQLQESGGGLVQPGGSLRLSCAASGFTFSSDAMTWVRQAPGK GLEWVSVISGSGGTTYYADSVKGRFTISRDNSKNTLYLQMNSLRAEDTAVYYCAKLDSSGYYYA RGPRYWGQGTLVTVSSASGGGGSGGGGSGGGGSDIQLTQSPSSLSASVGDRVTITCRASQSISS YLNWYQQKPGKAPKLLIYGASTLASGVPARFSGSGSGTHFTLTINSLQSEDSATYYCQQSYKRA SFGQGTKVEIKTTTPAPRPPTPAPTIASQPLSLRPEACRPAAGGAVHTRGLDFACDIYIWAPLA GTCGVLLLSLVITLYCKRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |
| 139101- nt Full CAR | 169 | ATGGCCCTCCCTGTCACCGCCCTGCTGCTTCCGCTGGCTCTTCTGCTCCACGCCGCTCGGCCCC AAGTGCAACTTCAAGAATCAGGCGGAGGACTCGTGCAGCCCGGAGGATCATTGCGGCTCTCGTG CGCCGCCTCGGGCTTCACCTTCTCGAGCGACGCCATGACCTGGGTCCGCCAGGCCCCGGGGAAG GGGCTGGAATGGGTGTCTGTGATTTCCGGCTCCGGGGGAACTACGTACTACGCCGATTCCGTGA AAGGTCGCTTCACTATCTCCCGGGACAACAGCAAGAACACCCTTTATCTGCAAATGAATTCCCT CCGCGCCGAGGACACCGCCGTGTACTACTGCGCCAAGCTGGACTCCTCGGGCTACTACTATGCC CGGGGTCCGAGATACTGGGGACAGGGAACCCTCGTGACCGTGTCCTCCGCGTCCGGCGGAGGAG GGTCGGGAGGGCGGGCCTCCGGCGGCGGCGGTTCGGACATCCAGCTGACCCAGTCCCCATCCTC ACTGAGCGCAAGCGTGGGCGACAGAGTCACCATTACATGCAGGGCGTCCCAGAGCATCAGCTCC TACCTGAACTGGTACCAACAGAAGCCTGGAAAGGCTCCTAAGCTGTTGATCTACGGGGCTTCGA CCCTGGCATCCGGGGTGCCCGCGAGGTTTAGCGGAAGCGGTAGCGGCACTCACTTCACTCTGAC CATTAACAGCCTCCAGTCCGAGGATTCAGCCACTTACTACTGTCAGCAGTCCTACAAGCGGGCC AGCTTCGGACAGGGCACTAAGGTCGAGATCAAGACCACTACCCCAGCACCGAGGCCACCCACCC CGGCTCCTACCATCGCCTCCCAGCCTCTGTCCCTGCGTCCGGAGGCATGTAGACCCGCAGCTGG TGGGGCCGTGCATACCCGGGGTCTTGACTTCGCCTGCGATATCTACATTTGGGCCCCTCTGGCT GGTACTTGCGGGGTCCTGCTGCTTTCACTCGTGATCACTCTTTACTGTAAGCGCGGTCGGAAGA AGCTGCTGTACATCTTTAAGCAACCCTTCATGAGGCCTGTGCAGACTACTCAAGAGGAGGACGG CTGTTCATGCCGGTTCCCAGAGGAGGAGGAAGGCGGCTGCGAACTGCGCGTGAAATTCAGCCGC AGCGCAGATGCTCCAGCCTACAAGCAGGGGCAGAACCAGCTCTACAACGAACTCAATCTTGGTC GGAGAGAGGAGTACGACGTGCTGGACAAGCGGAGAGGACGGGACCCAGAAATGGGCGGGAAGCC GCGCAGAAAGAATCCCAAGAGGGCCTGTACAACGAGCTCCAAAAGGATAAGATGGCAGAAGCC TATAGCGAGATTGGTATGAAAGGGGAACGCAGAAGAGGCAAAGGCCACGACGGACTGTACCAGG GACTCAGCACCGCCACCAAGGACACCTATGACGCTCTTCACATGCAGGCCCTGCCGCCTCGG |

139102

| 139102- aa ScFv domain | 170 | QVQLVQSGAEVKKPGASVKVSCKASGYTFSNYGITWVRQAPGQGLEWMGWISAYNGNTNYAQKF QGRVTMTRNTSISTAYMELSSLRSEDTAVYYCARGPYYYYMDVWGKGTMVTVSSASGGGGSGGR ASGGGGSEIVMTQSPLSLPVTPGEPASISCRSSQSLLYSNGYNYVDWYLQKPGQSPQLLIYLGS NRASGVPDRFSGSGSGTDFKLQISRVEAEDVGIYYCMQGRQFPYSFGQGTKVEIK |
| 139102- nt ScFv domain | 171 | CAAGTCCAACTGGTCCAGAGCGGTGCAGAAGTGAAGAAGCCCGGAGCGAGCGTGAAAGTGTCCT GCAAGGCTTCCGGGTACACCTTCTCCAACTACGGCATCACTTGGGTGCGCCAGGCCCCCGGGACA GGGCCTGGAATGGATGGGGTGGATTTCCGCGTACAACGGCAATACGAACTACGCTCAGAAGTTC CAGGGTAGAGTGACCATGACTAGGAACACCTCCATTTCCACCGCCTACATGGAACTGTCCTCCC TGCGGAGCGAGGACACCGCCGTGTACTATTGCGCCCGGGGACCATACTACTACTACATGGATGT CTGGGGGAAGGGGACTATGGTCACCGTGTCATCCGCCTCGGGAGGCGGCGGATCAGGAGGACGC GCCTCTGGTGGTGGAGGATCGGAGATCGTGATGACCCAGAGCCCTCTCTCCTTGCCCGTGACTC CTGGGGAGCCCGCATCCATTTCATGCCGGAGCTCCCAGTCACTTCTCTACTCCAACGGCTATAA CTACGTGGATTGGTACCTCCAAAAGCCGGGCCAGAGCCCGCAGCTGCTGATCTACCTGGGCTCG AACAGGGCCAGCGGAGTGCCTGACCGGTTCTCCGGGTCGGGAAGCGGGACCGACTTCAAGCTGC AAATCTCGAGAGTGGAGGCCGAGGACGTGGGAATCTACTACTGTATGCAGGGCCGCCAGTTTCC GTACTCGTTCGGACAGGGCACCAAAGTGGAAATCAAG |
| 139102- aa VH | 172 | QVQLVQSGAEVKKPGASVKVSCKASGYTFSNYGITWVRQAPGQGLEWMGWISAYNGNTNYAQKF QGRVTMTRNTSISTAYMELSSLRSEDTAVYYCARGPYYYYMDVWGKGTMVTVSS |
| 139102- aa VL | 173 | EIVMTQSPLSLPVTPGEPASISCRSSQSLLYSNGYNYVDWYLQKPGQSPQLLIYLGSNRASGVP DRFSGSGSGTDFKLQISRVEAEDVGIYYCMQGRQFPYSFGQGTKVEIK |
| 139102- aa Full CAR | 174 | MALPVTALLLPLALLLHAARPQVQLVQSGAEVKKPGASVKVSCKASGYTFSNYGITWVRQAPGQ GLEWMGWISAYNGNTNYAQKFQGRVTMTRNTSISTAYMELSSLRSEDTAVYYCARGPYYYYMDV WGKGTMVTVSSASGGGGSGGRASGGGGSEIVMTQSPLSLPVTPGEPASISCRSSQSLLYSNGYN YVDWYLQKPGQSPQLLIYLGSNRASGVPDRFSGSGSGTDFKLQISRVEAEDVGIYYCMQGRQFP YSFGQGTKVEIKTTTPAPRPPTPAPTIASQPLSLRPEACRPAAGGAVHTRGLDFACDIYIWAPL AGTCGVLLLSLVITLYCKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKNPQEGLYNELQKDKMAE AYSEIGMKGERRRGKGHDGLYQGLSTATKDTYDALHMQALPPR |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| 139102- nt<br>Full CAR | 175 | ATGGCCCTCCCTGTCACCGCCCTGCTGCTTCCGCTGGCTCTTCTGCTCCACGCCGCTCGGCCCC<br>AAGTCCAACTGGTCCAGAGCGGTGCAGAAGTGAAGAAGCCCGGAGCGAGCGTGAAAGTGTCCTG<br>CAAGGCTTCCGGGTACACCTTCTCCAACTACGGCATCACTTGGGTGCGCCAGGCCCCGGGACAG<br>GGCCTGGAATGGATGGGGTGGATTTCCGCGTACAACGGCAATACGAACTACGCTCAGAAGTTCC<br>AGGGTAGAGTGACCATGACTAGGAACACCTCCATTTCCACCGCCTACATGGAACTGTCCTCCCT<br>GCGGAGCGAGGACACCGCCGTGTACTATTGCGCCCGGGGACCATACTACTACTACATGGATGTC<br>TGGGGGAAGGGGACTATGGTCACCGTGTCATCCGCCTCGGGAGGCGGCGGATCAGGAGGACGCG<br>CCTCTGGTGGTGGAGGATCGGAGATCGTGATGACCCAGAGCCCTCTCTCCTTGCCCGTGACTCC<br>TGGGGAGCCCGCATCCATTTCATGCCGGAGCTCCCAGTCACTTCTCTACTCCAACGGCTATAAC<br>TACGTGGATTGGTACCTCCAAAAGCCGGGCCAGAGCCCGCAGCTGCTGATCTACCTGGGCTCGA<br>ACAGGGCCAGCGGAGTGCCTGACCGGTTCTCCGGGTCGGGAAGCGGGACCGACTTCAAGCTGCA<br>AATCTCGAGAGTGGAGGCCGAGGACGTGGGAATCTACTACTGTATGCAGGGCCGCCAGTTTCCG<br>TACTCGTTCGGACAGGGCACCAAAGTGGAAATCAAGACCACTACCCCAGCACCGAGGCCACCCA<br>CCCCGGCTCCTACCATCGCCTCCCAGCCTCTGTCCCTGCGTCCGGAGGCATGTAGACCCGCAGC<br>TGGTGGGGCCGTGCATACCCGGGGTCTTGACTTCGCCTGCGATATCTACATTTGGGCCCCTCTG<br>GCTGGTACTTGCGGGGTCCTGCTGCTTTCACTCGTGATCACTCTTTACTGTAAGCGCGGTCGGA<br>AGAAGCTGCTGTACATCTTTAAGCAACCCTTCATGAGGCCTGTGCAGACTACTCAAGAGGAGGA<br>CGGCTGTTCATGCCGGTTCCCAGAGGAGGAGGAAGGCTGCTGCGAACTGCGCGTGAAATTCAGC<br>CGCAGCGCAGATGCTCCAGCCTACAAGCAGGGGCAGAACCAGCTCTACAACGAACTCAATCTTG<br>GTCGGAGAGAGGAGTACGACGTGCTGGACAAGCGGAGAGGACGGGACCCAGAAATGGGCGGGAA<br>GCCGCGCAGAAAGAATCCCCAAGAGGGCCTGTACAACGAGCTCCAAAAGGATAAGATGGCAGAA<br>GCCTATAGCGAGATTGGTATGAAAGGGGAACGCAGAAGAGGCAAAGGCCACGACGGACTGTACC<br>AGGGACTCAGCACCGCCACCAAGGACACCTATGACGCTCTTCACATGCAGGCCCTGCCGCCTCG<br>G |
| | | 139104 |
| 139104- aa<br>ScFv domain | 176 | EVQLLETGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSSASGGGGSGGRASG<br>GGGSEIVLTQSPATLSVSPGESATLSCRASQSVSSNLAWYQQKPGQAPRLLIYGASTRASGIPD<br>RFSGSGSGTDFTLTISSLQAEDVAVYYCQQYGSSLTFGGGTKVEIK |
| 139104- nt<br>ScFv domain | 177 | GAAGTGCAATTGCTCGAAACTGGAGGAGGTCTGGTGCAACCTGGAGGATCACTTCGCCTGTCCT<br>GCGCCGTGTCGGGCTTTGCCCTGTCCAACCATGGAATGAGCTGGGTCCGCCGCGCGCCGGGGAA<br>GGGGCCTCGAATGGGTGTCCGGCATCGTCTACTCCGGCTCCACCTACTACGCCGCGTCCGTGAAG<br>GGCCGGTTCACGATTTCACGGGACAACTCGCGGAACACCCTGTACCTCCAAATGAATTCCCTTC<br>GGCCGGAGGATACTGCCATCTACTACTGCTCCGCCCACGGTGGCGAATCCGACGTCTGGGGCCA<br>GGGAACCACCGTGACCGTGTCCAGCGCGTCCGGGGGAGGAGGAAGCGGGGGTAGAGCATCGGGT<br>GGAGGCGGATCAGAGATCGTGCTGACCCAGTCCCCCGCCACCTTGAGCGTGTCACCAGGAGAGT<br>CCGCCACCCTGTCATGCCGCGCCAGCCAGTCCGTGTCCTCCAACCTGGCTTGGTACCAGCAGAA<br>GCCGGGGCAGGCCCCTAGACTCCTGATCTATGGGCGTCGACCCGGGCATCTGGAATTCCCGAT<br>AGGTTCAGCGGATCGGGCTCGGGCACTGACTTCACTCTGACCATCTCCTCGCTGCAAGCCGAGG<br>ACGTGGCTGTGTACTACTGTCAGCAGTACGGAAGCTCCCTGACTTTCGGTGGCGGGACCAAAGT<br>CGAGATTAAG |
| 139104- aa<br>VH | 178 | EVQLLETGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSS |
| 139104- aa<br>VL | 179 | EIVLTQSPATLSVSPGESATLSCRASQSVSSNLAWYQQKPGQAPRLLIYGASTRASGIPDRFSG<br>SGSGTDFTLTISSLQAEDVAVYYCQQYGSSLTFGGGTKVEIK |
| 139104- aa<br>Full CAR | 180 | MALPVTALLLPLALLLHAARPEVQLLETGGGLVQPGGSLRLSCAVSGFALSNHGMSWVRRAPGK<br>GLEWVSGIVYSGSTYYAASVKGRFTISRDNSRNTLYLQMNSLRPEDTAIYYCSAHGGESDVWGQ<br>GTTVTVSSASGGGGSGGRASGGGGSEIVLTQSPATLSVSPGESATLSCRASQSVSSNLAWYQQK<br>PGQAPRLLIYGASTRASGIPDRFSGSGSGTDFTLTISSLQAEDVAVYYCQQYGSSLTFGGGTKV<br>EIKTTTPAPRPPTPAPTIASQPLSLRPEACRPAAGGAVHTRGLDFACDIYIWAPLAGTCGVLLL<br>SLVITLYCKRGRKKLLYIFKQPFMRPVQTTQEEDGCSCRFPEEEEGGCELRVKFSRSADAPAYK<br>QGQNQLYNELNLGRREEYDVLDKRRGRDPEMGGKPRRKNPQEGLYNELQKDKMAEAYSEIGMKG<br>ERRRGKGHDGLYQGLSTATKDTYDALHMQALPPR |
| 139104- nt<br>Full CAR | 181 | ATGGCCCTCCCTGTCACCGCCCTGCTGCTTCCGCTGGCTCTTCTGCTCCACGCCGCTCGGCCCG<br>AAGTGCAATTGCTCGAAACTGGAGGAGGTCTGGTGCAACCTGGAGGATCACTTCGCCTGTCCTG<br>CGCCGTGTCGGGCTTTGCCCTGTCCAACCATGGAATGAGCTGGGTCCGCCGCGCGCCGGGGAAG<br>GGCCTCGAATGGGTGTCCGGCATCGTCTACTCCGGCTCCACCTACTACGCCGCGTCCGTGAAGG<br>GCCGGTTCACGATTTCACGGGACAACTCGCGGAACACCCTGTACCTCCAAATGAATTCCCTTCG<br>GCCGGAGGATACTGCCATCTACTACTGCTCCGCCCACGGTGGCGAATCCGACGTCTGGGGCCAG<br>GGAACCACCGTGACCGTGTCCAGCGCGTCCGGGGGAGGAGGAAGCGGGGGTAGAGCATCGGGTG<br>GAGGCGGATCAGAGATCGTGCTGACCCAGTCCCCCGCCACCTTGAGCGTGTCACCAGGAGAGTC<br>CGCCACCCTGTCATGCCGCGCCAGCCAGTCCGTGTCCTCCAACCTGGCTTGGTACCAGCAGAAG<br>CCGGGGCAGGCCCCTAGACTCCTGATCTATGGGCGTCGACCCGGGCATCTGGAATTCCCGATA<br>GGTTCAGCGGATCGGGCTCGGGCACTGACTTCACTCTGACCATCTCCTCGCTGCAAGCCGAGGA<br>CGTGGCTGTGTACTACTGTCAGCAGTACGGAAGCTCCCTGACTTTCGGTGGCGGGACCAAAGTC<br>GAGATTAAGACCACTACCCCAGCACCGAGGCCACCCACCCCGGCTCCTACCATCGCCTCCCAGC |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | CTCTGTCCCTGCGTCCGGAGGCATGTAGACCCGCAGCTGGTGGGGCCGTGCATACCCGGGGTCT<br>TGACTTCGCCTGCGATATCTACATTTGGGCCCCTCTGGCTGGTACTTGCGGGGTCCTGCTGCTT<br>TCACTCGTGATCACTCTTTACTGTAAGCGCGGTCGGAAGAAGCTGCTGTACATCTTTAAGCAAC<br>CCTTCATGAGGCCTGTGCAGACTACTCAAGAGGAGGACGGCTGTTCATGCCGGTTCCCAGAGGA<br>GGAGGAAGGCGGCTGCGAACTGCGCGTGAAATTCAGCCGCAGCGCAGATGCTCCAGCCTACAAG<br>CAGGGGCAGAACCAGCTCTACAACGAACTCAATCTTGGTCGGAGAGAGGAGTACGACGTGCTGG<br>ACAAGCGGAGAGGACGGGACCCAGAAATGGGCGGGAAGCCGCGCAGAAAGAATCCCCAAGAGGG<br>CCTGTACAACGAGCTCCAAAAGGATAAGATGGCAGAAGCCTATAGCGAGATTGGTATGAAAGGG<br>GAACGCAGAAGAGGCAAAGGCCACGACGGACTGTACCAGGGACTCAGCACCGCCACCAAGGACA<br>CCTATGACGCTCTTCACATGCAGGCCCTGCCGCCTCGG |

139106

| 139106- aa<br>ScFv domain | 182 | EVQLVETGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSSASGGGGSGGRASG<br>GGGSEIVMTQSPATLSVSPGERATLSCRASQSVSSKLAWYQQKPGQAPRLLMYGASIRATGIPD<br>RFSGSGSGTEFTLTISSLEPEDFAVYYCQQYGSSSWTFGQGTKVEIK |
| 139106- nt<br>ScFv domain | 183 | GAAGTGCAATTGGTGGAAACTGGAGGAGGACTTGTGCAACCTGGAGGATCATTGAGACTGAGCT<br>GCGCAGTGTCGGGATTCGCCCTGAGCAACCATGGAATGTCCTGGGTCAGAAGGGCCCCTGGAAA<br>AGGCCTCGAATGGGTGTCAGGGATCGTGTACTCCGGTTCCACTTACTACGCCGCCTCCGTGAAG<br>GGGCGCTTCACTATCTCACGGGATAACTCCCGCAATACCCTGTACCTCCAAATGAACAGCCTGC<br>GGCCGGAGGATACCGCCATCTACTACTGTTCCGCCCACGGTGGAGAGTCTGACGTCTGGGGCCA<br>GGGAACTACCGTGACCGTGTCCTCCGCGTCCGGCGGTGGAGGGAGCGGCGGCCGCGCCAGCGGC<br>GGCGGAGGCTCCGAGATCGTGATGACCCAGAGCCCCGCTACTCTGTCGGTGTCGCCCGGAGAAA<br>GGGCGACCCTGTCCTGCCGGGCGTCGCAGTCCGTGAGCAGCAAGCTGGCTTGGTACCAGCAGAA<br>GCCGGGCCAGGCACCACGCCTGCTTATGTACGGTGCCTCCATTCGGGCCACCGGAATCCCGGAC<br>CGGTTCTCGGGGTCGGGGTCCGGTACCGAGTTCACACTGACCATTTCCTCGCTCGAGCCCGAGG<br>ACTTTGCCGTCTATTACTGCCAGCAGTACGGCTCCTCCTCATGGACGTTCGGCCAGGGGACCAA<br>GGTCGAAATCAAG |
| 139106- aa<br>VH | 184 | EVQLVETGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSS |
| 139106- aa<br>VL | 185 | EIVMTQSPATLSVSPGERATLSCRASQSVSSKLAWYQQKPGQAPRLLMYGASIRATGIPDRFSG<br>SGSGTEFTLTISSLEPEDFAVYYCQQYGSSSWTFGQGTKVEIK |
| 139106- aa<br>Full CAR | 186 | MALPVTALLLPLALLLHAARPEVQLVETGGGLVQPGGSLRLSCAVSGFALSNHGMSWVRRAPGK<br>GLEWVSGIVYSGSTYYAASVKGRFTISRDNSRNTLYLQMNSLRPEDTAIYYCSAHGGESDVWGQ<br>GTTVTVSSASGGGGSGGRASGGGGSEIVMTQSPATLSVSPGERATLSCRASQSVSSKLAWYQQK<br>PGQAPRLLMYGASIRATGIPDRFSGSGSGTEFTLTISSLEPEDFAVYYCQQYGSSSWTFGQGTK<br>VEIKTTTPAPRPPTPAPTIASQPLSLRPEACRPAAGGAVHTRGLDFACDIYIWAPLAGTCGVLL<br>LSLVITLYCKRGRKKLLYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNELQKDKMAEAYSEIGMK<br>GERRRGKGHDGLYQGLSTATKDTYDALHMQALPPR |
| 139106- nt<br>Full CAR | 187 | ATGGCCCTCCCTGTCACCGCCCTGCTGCTTCCGCTGGCTCTTCTGCTCCACGCCGCTCGGCCCG<br>AAGTGCAATTGGTGGAAACTGGAGGAGGACTTGTGCAACCTGGAGGATCATTGAGACTGAGCTG<br>CGCAGTGTCGGGATTCGCCCTGAGCAACCATGGAATGTCCTGGGTCAGAAGGGCCCCTGGAAAA<br>GGCCTCGAATGGGTGTCAGGGATCGTGTACTCCGGTTCCACTTACTACGCCGCCTCCGTGAAGG<br>GGCGCTTCACTATCTCACGGGATAACTCCCGCAATACCCTGTACCTCCAAATGAACAGCCTGCG<br>GCCGGAGGATACCGCCATCTACTACTGTTCCGCCCACGGTGGAGAGTCTGACGTCTGGGGCCAG<br>GGAACTACCGTGACCGTGTCCTCCGCGTCCGGCGGTGGAGGGAGCGGCGGCCGCGCCAGCGGCG<br>GCGGAGGCTCCGAGATCGTGATGACCCAGAGCCCCGCTACTCTGTCGGTGTCGCCCGGAGAAAG<br>GGCGACCCTGTCCTGCCGGGCGTCGCAGTCCGTGAGCAGCAAGCTGGCTTGGTACCAGCAGAAG<br>CCGGGCCAGGCACCACGCCTGCTTATGTACGGTGCCTCCATTCGGGCCACCGGAATCCCGGACC<br>GGTTCTCGGGGTCGGGGTCCGGTACCGAGTTCACACTGACCATTTCCTCGCTCGAGCCCGAGGA<br>CTTTGCCGTCTATTACTGCCAGCAGTACGGCTCCTCCTCATGGACGTTCGGCCAGGGGACCAAG<br>GTCGAAATCAAGACCACTACCCCAGCACCGAGGCCACCCACCCCGGCTCCTACCATCGCCTCCC<br>AGCCTCTGTCCCTGCGTCCGGAGGCATGTAGACCCGCAGCTGGTGGGGCCGTGCATACCCGGGG<br>TCTTGACTTCGCCTGCGATATCTACATTTGGGCCCCTCTGGCTGGTACTTGCGGGGTCCTGCTG<br>CTTTCACTCGTGATCACTCTTTACTGTAAGCGCGGTCGGAAGAAGCTGCTGTACATCTTTAAGC<br>AACCCTTCATGAGGCCTGTGCAGACTACTCAAGAGGAGGACGGCTGTTCATGCCGGTTCCCAGA<br>GGAGGAGGAAGGCGGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAGGAGTACGACGTGC<br>TGGACAAGCGGAGAGGACGGGACCCAGAAATGGGCGGGAAGCCGCGCAGAAAGAATCCCCAAGA<br>GGGCCTGTACAACGAGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAGCACCGCCACCAAGG<br>ACACCTATGACGCTCTTCACATGCAGGCCCTGCCGCCTCGG |

TABLE 11-continued

Amino Acid and Nucleic Acid Sequences of the anti-BCMA scFv domains and anti-BCMA CAR molecules

| Name/ Description | SEQ ID NO: | Sequence |
|---|---|---|
| | | 139107 |
| 139107- aa ScFv domain | 188 | EVQLVETGGGVVQPGGSLRLSCAVSGFALSNHGMSWVRRAPGKGLEWVSGIVYSGSTYYAASVK GRFTISRDNSRNTLYLQMNSLRPEDTAIYYCSAHGGESDVWGQGTTVTVSSASGGGGSGGRASG GGGSEIVLTQSPGTLSLSPGERATLSCRASQSVGSTNLAWYQQKPGQAPRLLIYDASNRATGIP DRFSGGGSGTDFTLTISRLEPEDFAVYYCQQYGSSPPWTFGQGTKVEIK |
| 139107- nt ScFv domain | 189 | GAAGTGCAATTGGTGGAGACTGGAGGAGGAGTGGTGCAACCTGGAGGAAGCCTGAGACTGTCAT GCGCGGTGTCGGGCTTCGCCCTCTCCAACCACGGAATGTCCTGGGTCCGCCGGGCCCCTGGGAA AGGACTTGAATGGGTGTCCGGCATCGTGTACTCGGGTTCCACCTACTACGCGGCCTCAGTGAAG GGCCGGTTTACTATTAGCCGCGACAACTCCAGAAACACACTGTACCTCCAAATGAACTCGCTGC GGCCCGGAAGATACCGCTATCTACTACTGCTCCGCCCATGGGGGAGAGTCGGACGTCTGGGGACA GGGCACCACTGTCACTGTGTCCAGCGCTTCCGGCGGTGGTGGAAGCGGGGGACGGGCCTCAGGA GGCGGTGGCAGCGAGATTGTGCTGACCCAGTCCCCCGGGACCCTGAGCCTGTCCCCGGGAGAAA GGGCCACCCTCTCCTGTCGGGCATCCCAGTCCGTGGGGTCTACTAACCTTGCATGGTACCAGCA GAAGCCCGGCCAGGCCCCTCGCCTGCTGATCTACGACGCGTCCAATAGAGCCACCGGCATCCCG GATCGCTTCAGCGGAGGCGGATCGGGCACCGACTTCACCCTCACCATTTCAAGGCTGGAACCGG AGGACTTCGCCGTGTACTACTGCCAGCAGTATGGTTCGTCCCCACCCTGGACGTTCGGCCAGGG GACTAAGGTCGAGATCAAG |
| 139107- aa VH | 190 | EVQLVETGGGVVQPGGSLRLSCAVSGFALSNHGMSWVRRAPGKGLEWVSGIVYSGSTYYAASVK GRFTISRDNSRNTLYLQMNSLRPEDTAIYYCSAHGGESDVWGQGTTVTVSS |
| 139107- aa VL | 191 | EIVLTQSPGTLSLSPGERATLSCRASQSVGSTNLAWYQQKPGQAPRLLIYDASNRATGIPDRFS GGGSGTDFTLTISRLEPEDFAVYYCQQYGSSPPWTFGQGTKVEIK |
| 139107- aa Full CAR | 192 | MALPVTALLLPLALLLHAARPEVQLVETGGGVVQPGGSLRLSCAVSGFALSNHGMSWVRRAPGK GLEWVSGIVYSGSTYYAASVKGRFTISRDNSRNTLYLQMNSLRPEDTAIYYCSAHGGESDVWGQ GTTVTVSSASGGGGSGGRASGGGGSEIVLTQSPGTLSLSPGERATLSCRASQSVGSTNLAWYQQ KPGQAPRLLIYDASNRATGIPDRFSGGGSGTDFTLTISRLEPEDFAVYYCQQYGSSPPWTFGQG TKVEIKTTTPAPRPPTPAPTIASQPLSLRPEACRPAAGGAVHTRGLDFACDIYIWAPLAGTCGV LLLSLVITLYCKRGRKKLLYIFKQPFMRPVQTTQEEDGCSCRFPEEEEGGCELRVKFSRSADAP AYKQGQNQLYNELNLGRREEYDVLDKRRGRDPEMGGKPRRKNPQEGLYNELQKDKMAEAYSEIG MKGERRRGKGHDGLYQGLSTATKDTYDALHMQALPPR |
| 139107- nt Full CAR | 193 | ATGGCCCTCCCTGTCACCGCCCTGCTGCTTCCGCTGGCTCTTCTGCTCCACGCGCTCGGCCCG AAGTGCAATTGGTGGAGACTGGAGGAGGAGTGGTGCAACCTGGAGGAAGCCTGAGACTGTCATG CGCGGTGTCGGGCTTCGCCCTCTCCAACCACGGAATGTCCTGGGTCCGCCGGGCCCCTGGGAAA GGACTTGAATGGGTGTCCGGCATCGTGTACTCGGGTTCCACCTACTACGCGGCCTCAGTGAAGG GCCGGTTTACTATTAGCCGCGACAACTCCAGAAACACACTGTACCTCCAAATGAACTCGCTGCG GCCCGGAAGATACCGCTATCTACTACTGCTCCGCCCATGGGGGAGAGTCGGACGTCTGGGGACAG GGCACCACTGTCACTGTGTCCAGCGCTTCCGGCGGTGGTGGAAGCGGGGGACGGGCCTCAGGAG GCGGTGGCAGCGAGATTGTGCTGACCCAGTCCCCCGGGACCCTGAGCCTGTCCCCGGGAGAAAG GGCCACCCTCTCCTGTCGGGCATCCCAGTCCGTGGGGTCTACTAACCTTGCATGGTACCAGCAG AAGCCCGGCCAGGCCCCTCGCCTGCTGATCTACGACGCGTCCAATAGAGCCACCGGCATCCCGG ATCGCTTCAGCGGAGGCGGATCGGGCACCGACTTCACCCTCACCATTTCAAGGCTGGAACCGGA GGACTTCGCCGTGTACTACTGCCAGCAGTATGGTTCGTCCCCACCCTGGACGTTCGGCCAGGGG ACTAAGGTCGAGATCAAGACCACTACCCCAGCACCGAGGCCACCCACCCCGGCTCCTACCATCG CCTCCCAGCCTCTGTCCCTGCGTCCGGAGGCATGTAGACCCGCAGCTGGTGGGGCCGTGCATAC CCGGGGTCTTGACTTCGCCTGCGATATCTACATTTGGGCCCCTCTGGCTGGTACTTGCGGGGTC CTGCTGCTTTCACTCGTGATCACTCTTTACTGTAAGCGCGGTCGGAAGAAGCTGCTGTACATCT TTAAGCAACCCTTCATGAGGCCTGTGCAGACTACTCAAGAGGAGGACGGCTGTTCATGCCGGTT CCCAGAGGAGGAGGAAGGCGGCTGCGAACTGCGCGTGAAATTCAGCCGCAGCGCAGATGCTCCA GCCTACAAGCAGGGGCAGAACCAGCTCTACAACGAACTCAATCTTGGTCGGAGAGAGGAGTACG ACGTGCTGGACAAGCGGAGGACGGGACCCGAGAAATGGGCGGGAAGCCGCGCAGAAAGAATCC CAAGAGGGCCTGTACAACGAGCTCCAAAAGGATAAGATGGCAGAAGCCTATAGCGAGATTGGT ATGAAAGGGGAACGCAGAAGAGGCAAAGGCCACGACGGACTGTACCAGGGACTCAGCACCGCCA CCAAGGACACCTATGACGCTCTTCACATGCAGGCCCTGCCGCCTCGG |
| | | 139108 |
| 139108- aa ScFv domain | 194 | QVQLVESGGGLVKPGGSLRLSCAASGFTFSDYYMSWIRQAPGKGLEWVSYISSSGSTIYYADSV KGRFTISRDNAKNSLYLQMNSLRAEDTAVYYCARESGDGMDVWGQGTTVTVSSASGGGSGGGRA SGGGGSDIQMTQSPSSLSASVGDRVTITCRASQSISSYLNWYQQKPGKAPKLLIYAASSLQSGV PSRFSGSGSGTDFTLTISSLQPEDFATYYCQQSYTLAFGQGTKVDIK |
| 139108- nt ScFv domain | 195 | CAAGTGCAACTCGTGGAATCTGGTGGAGGACTCGTGAAACCTGGAGGATCATTGAGACTGTCAT GCGCGGCCTCGGGATTCACGTTCTCCGATTACTACATGAGCTGGATTCGCCAGGCTCCGGGGAA GGGACTGGAATGGGTGTCCTACATTTCCTCATCCGGCTCCACCATCTACTACGCGGACTCCGTG AAGGGGAGATTCACCATTAGCCGCGATAACGCCAAGAACAGCCTGTACCTTCAGATGAACTCCC TGCGGGCTGAAGATACTGCCGTCTACTACTGCGCAAGGGAGAGCGGAGATGGGATGGACGTCTG GGGACAGGGTACCACTGTGACCGTGTCGTCGGCCTCCGGCGGAGGGGGTTCGGGTGGAAGGGCC |

TABLE 11-continued

Amino Acid and Nucleic Acid Sequences of the anti-BCMA scFv domains and anti-BCMA CAR molecules

| Name/ Description | SEQ ID NO: | Sequence |
| --- | --- | --- |
| | | AGCGGCGGCGGAGGCAGCGACATCCAGATGACCCAGTCCCCCTCATCGCTGTCCGCCTCCGTGG GCGACCGCGTCACCATCACATGCCGGGCCTCACAGTCGATCTCCTCCTACCTCAATTGGTATCA GCAGAAGCCCGGAAAGGCCCCTAAGCTTCTGATCTACGCAGCGTCCTCCCTGCAATCCGGGGTC CCATCTCGGTTCTCCGGCTCGGGCAGCGGTACCGACTTCACTCTGACCATCTCGAGCCTGCAGC CGGAGGACTTCGCCACTTACTACTGTCAGCAAAGCTACACCCTCGCGTTTGGCCAGGGCACCAA AGTGGACATCAAG |
| 139108- aa VH | 196 | QVQLVESGGGLVKPGGSLRLSCAASGFTFSDYYMSWIRQAPGKGLEWVSYISSSGSTIYYADSV KGRFTISRDNAKNSLYLQMNSLRAEDTAVYYCARESGDGMDVWGQGTTVTVSS |
| 139108- aa VL | 197 | DIQMTQSPSSLSASVGDRVTITCRASQSISSYLNWYQQKPGKAPKLLIYAASSLQSGVPSRFSG SGSGTDFTLTISSLQPEDFATYYCQQSYTLAFGQGTKVDIK |
| 139108- aa Full CAR | 198 | MALPVTALLLPLALLLHAARPQVQLVESGGGLVKPGGSLRLSCAASGFTFSDYYMSWIRQAPGK GLEWVSYISSSGSTIYYADSVKGRFTISRDNAKNSLYLQMNSLRAEDTAVYYCARESGDGMDVW GQGTTVTVSSASGGGGSGGRASGGGGSDIQMTQSPSSLSASVGDRVTITCRASQSISSYLNWYQ QKPGKAPKLLIYAASSLQSGVPSRFSGSGSGTDFTLTISSLQPEDFATYYCQQSYTLAFGQGTK VDIKTTTPAPRPPTPAPTIASQPLSLRPEACRPAAGGAVHTRGLDFACDIYIWAPLAGTCGVLL LSLVITLYCKRGRKKLLYIFKQPFMRPVQTTQEEDGCSCRFPEEEEGGCELRVKFSRSADAPAY KQGQNQLYNELNLGRREEYDVLDKRRGRDPEMGGKPRRKNPQEGLYNELQKDKMAEAYSEIGMK GERRRGKGHDGLYQGLSTATKDTYDALHMQALPPR |
| 139108- nt Full CAR | 199 | ATGGCCCTCCCTGTCACCGCCCTGCTGCTTCCGCTGGCTCTTCTGCTCCACGCCGCTCGGCCCC AAGTGCAACTCGTGGAATCTGGTGGAGGACTCGTGAAACCTGGAGGATCATTGAGACTGTCATG CGCGGCCTCGGGATTCACGTTCTCCGATTACTACATGAGCTGGATTCGCCAGGCTCCGGGGAAG GACTGGAATGGGTGTCCTACATTTCCTCATCCGGCTCCACCATCTACTACGCGGACTCCGTGA AGGGGAGATTCACCATTAGCCGCGATAACGCCAAGAACAGCCTGTACCTTCAGATGAACTCCCT GCGGGCTGAAGATACTGCCGTCTACTACTGCGCAAGGGAGAGCGGAGATGGGATGGACGTCTGG GGACAGGGTACCACTGTGACCGTGTCGTCGGCCTCCGGCGGAGGGGGTTCGGGTGGAAGGGCCA GCGGCGGCGGAGGCAGCGACATCCAGATGACCCAGTCCCCCTCATCGCTGTCCGCCTCCGTGGG CGACCGCGTCACCATCACATGCCGGGCCTCACAGTCGATCTCCTCCTACCTCAATTGGTATCAG CAGAAGCCCGGAAAGGCCCCTAAGCTTCTGATCTACGCAGCGTCCTCCCTGCAATCCGGGGTCC CATCTCGGTTCTCCGGCTCGGGCAGCGGTACCGACTTCACTCTGACCATCTCGAGCCTGCAGCC GGAGGACTTCGCCACTTACTACTGTCAGCAAAGCTACACCCTCGCGTTTGGCCAGGGCACCAAA GTGGACATCAAGACCACTACCCCAGCACCGAGGCCACCCACCCCGGCTCCTACCATCGCTCCC AGCCTCTGTCCCTGCGTCCGGAGGCATGTAGACCCGCAGCTGGTGGGGCCGTGCATACCCGGGG TCTTGACTTCGCCTGCGATATCTACATTTGGGCCCCTCTGGCTGGTACTTGCGGGGTCCTGCTG CTTTTCACTCGTGATCACTCTTTACTGTAAGCGCGGTCGGAAGAAGCTGCTGTACATCTTTAAGC AACCCTTCATGAGGCCTGTGCAGACTACTCAAGAGGAGGACGGCTGTTCATGCCGGTTCCCAGA GGAGGAGGAAGGCGGCTGCGAACTGCGCGTGAAATTCAGCCGCAGCGCAGATGCTCCAGCCTAC AAGCAGGGGCAGAACCAGCTCTACAACGAACTCAATCTTGGTCGGAGAGAGGAGTACGACGTGC TGGACAAGCGGAGAGGACGGGACCCAGAAATGGGCGGGAAGCCGCGCAGAAAGAATCCCCAAGA GGGCCTGTACAACGAGCTCCAAAAGGATAAGATGGCAGAAGCCTATAGCGAGATTGGTATGAAA GGGGAACGCAGAAGAGGCAAAGGCCACGACGGACTGTACCAGGGACTCAGCACCGCCACCAAGG ACACCTATGACGCTCTTCACATGCAGGCCCTGCCGCCTCGG |

139109

| 139109- aa ScFv domain | 200 | EVQLVESGGGLVQPGGSLRLSCAVSGFALSNHGMSWVRRAPGKGLEWVSGIVYSGSTYYAASVK GRFTISRDNSRNTLYLQMNSLRPEDTAIYYCSAHGGESDVWGQGTTVTVSSASGGGGSGGRASG GGGSDIQLTQSPSSLSASVGDRVTITCRASQSISSYLNWYQQKPGKAPKLLIYAASSLQSGVPS RFSGSGSGTDFTLTISSLQPEDFATYYCQQSYSTPYTFGQGTKVEIK |
| 139109- nt ScFv domain | 201 | GAAGTGCAATTGGTGGAATCAGGGGGAGGACTTGTGCAGCCTGGAGGATCGCTGAGACTGTCAT GTGCCGTGTCCGGCTTTGCCCTGTCCAACCACGGGATGTCCTGGGTCCGCCGCGCGCCTGGAAA GGGCCTCGAATGGGTGTCGGGTATTGTGTACAGCGGTAGCACCTACTATGCCGCATCCGTGAAG GGGAGATTCACCATCAGCCGGGACAACTCCAGGAACACTCTGTACCTCCAAATGAATTCGCTGA GGCCAGAGGACACTGCCATCTACTACTGCTCCGCGCATGGCGGAGAGTCCGACGTCTGGGGACA GGGGACCACCGTGACCGTGTCTAGCGCGTCCGGCGGAGGCGGCAGCGGGGGTCGGGCATCAGGG GGCGGCGGATCGGACATCCAGCTCACCCAGTCCCCGAGCTCGCTGTCCGCCTCCGTGGGAGATC GGGTCACCATCACGTGCCGCGCCAGCCAGTCGATTTCCTCCTACCTGAACTGGTACCAACAGAA GCCCGGAAAAGCCCCGAAGCTTCTCATCTACGCCGCCTCGAGCCTGCAGTCAGGAGTGCCCTCA CGGTTCTCCGGCTCCGGTTCCGGTACTGATTTCACCCTGACCATTTCCTCCCTGCAACCGGAGG ACTTCGCTACTTACTACTGCCAGCAGTCGTACTCCACCCCCTACACTTTCGGACAAGGCACCAA GGTCGAAATCAAG |
| 139109- aa VH | 202 | EVQLVESGGGLVQPGGSLRLSCAVSGFALSNHGMSWVRRAPGKGLEWVSGIVYSGSTYYAASVK GRFTISRDNSRNTLYLQMNSLRPEDTAIYYCSAHGGESDVWGQGTTVTVSS |
| 139109- aa VL | 203 | DIQLTQSPSSLSASVGDRVTITCRASQSISSYLNWYQQKPGKAPKLLIYAASSLQSGVPSRFSG SGSGTDFTLTISSLQPEDFATYYCQQSYSTPYTFGQGTKVEIK |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| 139109- aa<br>Full CAR | 204 | MALPVTALLLPLALLLHAARPEVQLVESGGGLVQPGGSLRLSCAVSGFALSNHGMSWVRRAPGK<br>GLEWVSGIVYSGSTYYAASVKGRFTISRDNSRNTLYLQMNSLRPEDTAIYYCSAHGGESDVWGQ<br>GTTVTVSSASGGGGSGGRASGGGGSDIQLTQSPSSLSASVGDRVTITCRASQSISSYLNWYQQK<br>PGKAPKLLIYAASSLQSGVPSRFSGSGSGTDFTLTISSLQPEDFATYYCQQSYSTPYTFGQGTK<br>VEIKTTTPAPRPPTPAPTIASQPLSLRPEACRPAAGGAVHTRGLDFACDIYIWAPLAGTCGVLL<br>LSLVITLYCKRGRKKLLYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNELQKDKMAEAYSEIGMK<br>GERRRGKGHDGLYQGLSTATKDTYDALHMQALPPR |
| 139109- nt<br>Full CAR | 205 | ATGGCCCTCCCTGTCACCGCCCTGCTGCTTCCGCTGGCTCTTCTGCTCCACGCCGCTCGGCCCG<br>AAGTGCAATTGGTGGAATCAGGGGGAGGACTTGTGCAGCCTGGAGGATCGCTGAGACTGTCATG<br>TGCCGTGTCCGGCTTTGCCCTGTCCAACCACGGGATGTCCTGGGTCCGCCGCGCGCCTGGAAAG<br>GGCCTCGAATGGGTGTCGGGTATTGTGTACAGCGGTAGCACCTACTATGCCGCATCCGTGAAGG<br>GGAGATTCACCATCAGCCGGGACAACTCCAGGAACACTCTGTACCTCCAAATGAATTCGCTGAG<br>GCCAGAGGACACTGCCATCTACTACTGCTCCGCGCATGGCGGAGAGTCCGACGTCTGGGGACAG<br>GGGACCACCGTGACCGTGTCTAGCGCGTCCGGCGGAGGCGGCAGCGGGGGTCGGGCATCAGGGG<br>GCGGCGGATCGGACATCCAGCTCACCCAGTCCCCGAGCTCGCTGTCCGCCTCCGTGGGAGATCG<br>GGTCACCATCACGTGCCGCGCCAGCCAGTCGATTTCCTCCTACCTGAACTGGTACCAACAGAAG<br>CCCGGAAAAGCCCCGAAGCTTCTCATCTACGCCGCCTCGAGCCTGCAGTCAGGAGTGCCCTCAC<br>GGTTCTCCGGCTCCGGTTCCGGTACTGATTTCACCCTGACCATTTCCTCCCTGCAACCGGAGGA<br>CTTCGCTACTTACTACTGCCAGCAGTCGTACTCCACCCCCTACACTTTCGGACAAGGCACCAAG<br>GTCGAAATCAAGACCACTACCCCAGCACCGAGGCCACCCACCCCGGCTCCTACCATCGCCTCCC<br>AGCCTCTGTCCCTGCGTCCGGAGGCATGTAGACCCGCAGCTGGTGGGGCCGTGCATACCCGGGG<br>TCTTGACTTCGCCTGCGATATCTACATTTGGGCCCCTCTGGCTGGTACTTGCGGGGTCCTGCTG<br>CTTTTCACTCGTGATCACTCTTTACTGTAAGCGCGGTCGGAAGAAGCTGCTGTACATCTTTAAGC<br>AACCCTTCATGAGGCCTGTGCAGACTACTCAAGAGGAGGACGGCTGTTCATGCCGGTTCCCAGA<br>GGAGGAGGAAGGCGGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAGGAGTACGACGTGC<br>TGGACAAGCGGAGAGGACGGGACCCAGAAATGGGCGGGAAGCCGCGCAGAAAGAATCCCCAAGA<br>GGGCCTGTACAACGAGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAGCACCGCCACCAAGG<br>ACACCTATGACGCTCTTCACATGCAGGCCCTGCCGCCTCGG |

139110

| 139110- aa<br>ScFv domain | 206 | QVQLVQSGGGLVKPGGSLRLSCAASGFTFSDYYMSWIRQAPGKGLEWVSYISSSGNTIYYADSV<br>KGRFTISRDNAKNSLYLQMNSLRAEDTAVYYCARSTMVREDYWGQGTLVTVSSASGGGGSGGRA<br>SGGGGSDIVLTQSPLSLPVTLGQPASISCKSSESLVHNSGKTYLNWFHQRPGQSPRRLIYEVSN<br>RDSGVPDRFTGSGSGTDFTLKISRVEAEDVGVYYCMQGTHWPGTFGQGTKLEIK |
| 139110- nt<br>ScFv domain | 207 | CAAGTGCAACTGGTGCAAAGCGGAGGAGGATTGGTCAAACCCGGAGGAAGCCTGAGACTGTCAT<br>GCGCGGCCTCTGGATTCACCTTCTCCGATTACTACATGTCATGGATCAGACAGGCCCCGGGGAA<br>GGGCCTCGAATGGGTGTCCTACATCTCGTCCTCCGGGAACACCATCTACTACGCCGACAGCGTG<br>AAGGGCCGCTTTACCATTTCCCGCGACAACGCAAAGAACTCGCTGTACCTTCAGATGAATTCCC<br>TGCGGGCTGAAGATACCGCGGTGTACTATTGCGCCCGGTCCACTATGGTCCGGGAGGACTACTG<br>GGGACAGGGCACACTCGTGACCGTGTCCAGCGCGAGCGGGGTGGAGGCAGCGGTGGACGCGCC<br>TCCGGCGGCGGCGGTTCAGACATCGTGCTGACTCAGTCGCCCCTGTCGCTGCCGGTCACCCTGG<br>GCCAACCGGCCTCAATTAGCTGCAAGTCCTCGGAGAGCCTGGTGCACAACTCAGGAAAGACTTA<br>CCTGAACTGGTTCCATCAGCGGCCTGGACAGTCCCCACGGAGGCTCATCTATGAAGTGTCCAAC<br>AGGGATTCGGGGTGCCCGACCGCTTCACTGGCTCCGGGTCCGGCACCGACTTCACCTTGAAAA<br>TCTCCAGAGTGGAAGCCGAGGACGTGGGCGTGTACTACTGTATGCAGGGTACCCACTGGCCTGG<br>AACCTTTGGACAAGGAACTAAGCTCGAGATTAAG |
| 139110- aa<br>VH | 208 | QVQLVQSGGGLVKPGGSLRLSCAASGFTFSDYYMSWIRQAPGKGLEWVSYISSSGNTIYYADSV<br>KGRFTISRDNAKNSLYLQMNSLRAEDTAVYYCARSTMVREDYWGQGTLVTVSS |
| 139110- aa<br>VL | 209 | DIVLTQSPLSLPVTLGQPASISCKSSESLVHNSGKTYLNWFHQRPGQSPRRLIYEVSNRDSGVP<br>DRFTGSGSGTDFTLKISRVEAEDVGVYYCMQGTHWPGTFGQGTKLEIK |
| 139110- aa<br>Full CAR | 210 | MALPVTALLLPLALLLHAARPQVQLVQSGGGLVKPGGSLRLSCAASGFTFSDYYMSWIRQAPGK<br>GLEWVSYISSSGNTIYYADSVKGRFTISRDNAKNSLYLQMNSLRAEDTAVYYCARSTMVREDYW<br>GQGTLVTVSSASGGGGSGGRASGGGGSDIVLTQSPLSLPVTLGQPASISCKSSESLVHNSGKTY<br>LNWFHQRPGQSPRRLIYEVSNRDSGVPDRFTGSGSGTDFTLKISRVEAEDVGVYYCMQGTHWPG<br>TFGQGTKLEIKTTTPAPRPPTPAPTIASQPLSLRPEACRPAAGGAVHTRGLDFACDIYIWAPLA<br>GTCGVLLLSLVITLYCKRGRKKLLYIFKQPFMRPVQTTQEEDGCSCRFPEEEEGGCELRVKFSR<br>SADAPAYKQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 139110- nt<br>Full CAR | 211 | ATGGCCCTCCCTGTCACCGCCCTGCTGCTTCCGCTGGCTCTTCTGCTCCACGCCGCTCGGCCCC<br>AAGTGCAACTGGTGCAAAGCGGAGGAGGATTGGTCAAACCCGGAGGAAGCCTGAGACTGTCATG<br>CGCGGCCTCTGGATTCACCTTCTCCGATTACTACATGTCATGGATCAGACAGGCCCCGGGGAAG<br>GGCCTCGAATGGGTGTCCTACATCTCGTCCTCCGGGAACACCATCTACTACGCCGACAGCGTGA<br>AGGGCCGCTTTACCATTTCCCGCGACAACGCAAAGAACTCGCTGTACCTTCAGATGAATTCCCT |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | GCGGGCTGAAGATACCGCGGTGTACTATTGCGCCCGGTCCACTATGGTCCGGGAGGACTACTGG<br>GGACAGGGCACACTCGTGACCGTGTCCAGCGCGAGCGGGGGTGGAGGCAGCGGTGGACGCGCCT<br>CCGGCGGCGGCGGTTCAGACATCGTGCTGACTCAGTCGCCCCTGTCGCTGCCGGTCACCCTGGG<br>CCAACCGGCCTCAATTAGCTGCAAGTCCTCGGAGAGCCTGGTGCACAACTCAGGAAAGACTTAC<br>CTGAACTGGTTCCATCAGCGGCCTGGACAGTCCCCACGGAGGCTCATCTATGAAGTGTCCAACA<br>GGGATTCCGGGGTGCCCGACCGCTTCACTGGCTCCGGGTCCGGCACCGACTTCACCTTGAAAAT<br>CTCCAGAGTGGAAGCCGAGGACGTGGGCGTGTACTACTGTATGCAGGGTACCCACTGGCCTGGA<br>ACCTTTGGACAAGGAACTAAGCTCGAGATTAAGACCACTACCCCAGCACCGAGGCACCCACCC<br>CGGCTCCTACCATCGCCTCCCAGCCTCTGTCCCTGCGTCCGGAGGCATGTAGACCCGCAGCTGG<br>TGGGGCCGTGCATACCCGGGGTCTTGACTTCGCCTGCGATATCTACATTTGGGCCCCTCTGGCT<br>GGTACTTGCGGGGTCCTGCTGCTTTCACTCGTGATCACTCTTTACTGTAAGCGCGGTCGGAAGA<br>AGCTGCTGTACATCTTTAAGCAACCCTTCATGAGGCCTGTGCAGACTACTCAAGAGGAGGACGG<br>CTGTTCATGCCGGTTCCCAGAGGAGGAGGAAGGCGGCTGCGAACTGCGCGTGAAATTCAGCCGC<br>AGCGCAGATGCTCCAGCCTACAAGCAGGGGCAGAACCAGCTCTACAACGAACTCAATCTTGGTC<br>GGAGAGAGGAGTACGACGTGCTGGACAAGCGGAGAGGACGGGACCCAGAAATGGGCGGGAAGCC<br>GCGCAGAAAGAATCCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGACGGACTGTACCAGG<br>GACTCAGCACCGCCACCAAGGACACCTATGACGCTCTTCACATGCAGGCCCTGCCGCCTCGG |
| | | 139112 |
| 139112- aa<br>ScFv domain | 212 | QVQLVESGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSSASGGGGSGGRASG<br>GGGSDIRLTQSPSPLSASVGDRVTITCQASEDINKFLNWYHQTPGKAPKLLIYDASTLQTGVPS<br>RFSGSGSGTDFTLTINSLQPEDIGTYYCQQYESLPLTFGGGTKVEIK |
| 139112- nt<br>ScFv domain | 213 | CAAGTGCAACTCGTGGAATCTGGTGGAGGACTCGTGCAACCCGGTGGAAGCCTTAGGCTGTCGT<br>GCGCCGTCAGCGGGTTTGCTCTGAGCAACCATGGAATGTCCTGGGTCCGCCGGGCACCGGGAAA<br>AGGGCTGGAATGGGTGTCCGGCATCGTGTACAGCGGGTCAACCTATTACGCCGCGTCCGTGAAG<br>GGCAGATTCACTATCTCAAGAGACAACAGCCGGAACACCCTGTACTTGCAAATGAATTCCCTGC<br>GCCCCGAGGACACCGCCATCTACTACTGCTCCGCCCACGGAGGAGAGTCGGACGTGTGGGGCCA<br>GGGAACGACTGTGACTGTGTCCAGCGCATCAGGAGGGGTGGTTCGGGCGGCCGGGCCTCGGGG<br>GGAGGAGGTTCCGACATTCGGCTGACCCAGTCCCCGTCCCCACTGTCGGCCTCCGTCGGCGACC<br>GCGTGACCATCACTTGTCAGGCGTCCGAGGACATTAACAAGTTCCTGAACTGGTACCACCAGAC<br>CCCTGGAAAGGCCCCAAGCTGCTGATCTACGATGCCTCGACCCTTCAAACTGGAGTGCCTAGC<br>CGGTTCTCCGGGTCCGGCTCCGGCACTGATTTCACTCTGACCATCAACTCATTGCAGCCGGAAG<br>ATATCGGGACCTACTATTGCCAGCAGTACGAATCCCTCCCGCTCACATTCGGCGGGGAACCAA<br>GGTCGAGATTAAG |
| 139112- aa<br>VH | 214 | QVQLVESGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSS |
| 139112- aa<br>VL | 215 | DIRLTQSPSPLSASVGDRVTITCQASEDINKFLNWYHQTPGKAPKLLIYDASTLQTGVPSRFSG<br>SGSGTDFTLTINSLQPEDIGTYYCQQYESLPLTFGGGTKVEIK |
| 139112- aa<br>Full CAR | 216 | MALPVTALLLPLALLLHAARPQVQLVESGGGLVQPGGSLRLSCAVSGFALSNHGMSWVRRAPGK<br>GLEWVSGIVYSGSTYYAASVKGRFTISRDNSRNTLYLQMNSLRPEDTAIYYCSAHGGESDVWGQ<br>GTTVTVSSASGGGGSGGRASGGGGSDIRLTQSPSPLSASVGDRVTITCQASEDINKFLNWYHQT<br>PGKAPKLLIYDASTLQTGVPSRFSGSGSGTDFTLTINSLQPEDIGTYYCQQYESLPLTFGGGTK<br>VEIKTTTPAPRPPTPAPTIASQPLSLRPEACRPAAGGAVHTRGLDFACDIYIWAPLAGTCGVLL<br>LSLVITLYCKRGRKKLLYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNELQKDKMAEAYSEIGMK<br>GERRRGKGHDGLYQGLSTATKDTYDALHMQALPPR |
| 139112- nt<br>Full CAR | 217 | ATGGCCCTCCCTGTCACCGCCCTGCTGCTTCCGCTGGCTCTTCTGCTCCACGCCGCTCGGCCCC<br>AAGTGCAACTCGTGGAATCTGGTGGAGGACTCGTGCAACCCGGTGGAAGCCTTAGGCTGTCGTG<br>CGCCGTCAGCGGGTTTGCTCTGAGCAACCATGGAATGTCCTGGGTCCGCCGGGCACCGGGAAAA<br>GGGCTGGAATGGGTGTCCGGCATCGTGTACAGCGGGTCAACCTATTACGCCGCGTCCGTGAAGG<br>GCAGATTCACTATCTCAAGAGACAACAGCCGGAACACCCTGTACTTGCAAATGAATTCCCTGCG<br>CCCCGAGGACACCGCCATCTACTACTGCTCCGCCCACGGAGGAGAGTCGGACGTGTGGGGCCAG<br>GGAACGACTGTGACTGTGTCCAGCGCATCAGGAGGGGTGGTTCGGGCGGCCGGGCCTCGGGGG<br>GAGGAGGTTCCGACATTCGGCTGACCCAGTCCCCGTCCCCACTGTCGGCCTCCGTCGGCGACCG<br>CGTGACCATCACTTGTCAGGCGTCCGAGGACATTAACAAGTTCCTGAACTGGTACCACCAGACC<br>CCTGGAAAGGCCCCAAGCTGCTGATCTACGATGCCTCGACCCTTCAAACTGGAGTGCCTAGCC<br>GGTTCTCCGGGTCCGGCTCCGGCACTGATTTCACTCTGACCATCAACTCATTGCAGCCGGAAGA<br>TATCGGGACCTACTATTGCCAGCAGTACGAATCCCTCCCGCTCACATTCGGCGGGGAACCAAG<br>GTCGAGATTAAGACCACTACCCCAGCACCGAGGCCACCCACCCCGGCTCCTACCATCGCCTCCC<br>AGCCTCTGTCCCTGCGTCCGGAGGCATGTAGACCCGCAGCTGGTGGGGCCGTGCATACCCGGGG<br>TCTTGACTTCGCCTGCGATATCTACATTTGGGCCCCTCTGGCTGGTACTTGCGGGGTCCTGCTG<br>CTTTCACTCGTGATCACTCTTTACTGTAAGCGCGGTCGGAAGAAGCTGCTGTACATCTTTAAGC<br>AACCCTTCATGAGGCCTGTGCAGACTACTCAAGAGGAGGACGGCTGTTCATGCCGGTTCCCAGA<br>GGAGGAGGAAGGCGGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAGGAGTACGACGTGC |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| | | TGGACAAGCGGAGAGGACGGGACCCAGAAATGGGCGGGAAGCCGCGCAGAAAGAATCCCCAAGA<br>GGGCCTGTACAACGAGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAGCACCGCCACCAAGG<br>ACACCTATGACGCTCTTCACATGCAGGCCCTGCCGCCTCGG |

139113

| 139113- aa ScFv domain | 218 | EVQLVETGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSSASGGGGSGGRASG<br>GGGSETTLTQSPATLSVSPGERATLSCRASQSVGSNLAWYQQKPGQGPRLLIYGASTRATGIPA<br>RFSGSGSGTEFTLTISSLQPEDFAVYYCQQYNDWLPVTFGQGTKVEIK |
| 139113- nt ScFv domain | 219 | GAAGTGCAATTGGTGGAAACTGGAGGAGGACTTGTGCAACCTGGAGGATCATTGCGGCTCTCAT<br>GCGCTGTCTCCGGCTTCGCCCTGTCAAATCACGGGATGTCGTGGGTCAGACGGGCCCCGGGAAA<br>GGGTCTGGAATGGGTGTCGGGGATTGTGTACAGCGGCTCCACCTACTACGCCGCTTCGGTCAAG<br>GGCCGCTTCACTATTTCACGGGACAACAGCCGCAACACCCTCTATCTGCAAATGAACTCTCTCC<br>GCCCGGAGGATACCGCCATCTACTACTGCTCCGCACACGGCGGCGAATCCGACGTGTGGGGACA<br>GGGAACCACTGTCACCGTGTCGTCCGCATCCGGTGGCGGAGGATCGGGTGGCCGGGCCTCCGGG<br>GGCGGCGGCAGCGAGACTACCCTGACCCAGTCCCCTGCCACTCTGTCCGTGAGCCCGGGAGAGA<br>GAGCCACCCTTAGCTGCCGGGCCAGCCAGAGCGTGGGCTCCAACCTGGCCTGGTACCAGCAGAA<br>GCCAGGACAGGGTCCCAGGCTGCTGATCTACGGAGCCTCCACTCGCGCGACCGGCATCCCCGCG<br>AGGTTCTCCGGGTCGGGTTCCGGGACCGAGTTCACCCTGACCATCTCCTCCCTCCAACCGGAGG<br>ACTTCGCGGTGTACTACTGTCAGCAGTACAACGATTGGCTGCCCGTGACATTTGGACAGGGGAC<br>GAAGGTGGAAATCAAA |
| 139113- aa VH | 220 | EVQLVETGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSS |
| 139113- aa VL | 221 | ETTLTQSPATLSVSPGERATLSCRASQSVGSNLAWYQQKPGQGPRLLIYGASTRATGIPARFSG<br>SGSGTEFTLTISSLQPEDFAVYYCQQYNDWLPVTFGQGTKVEIK |
| 139113- aa Full CAR | 222 | MALPVTALLLPLALLLHAARPEVQLVETGGGLVQPGGSLRLSCAVSGFALSNHGMSWVRRAPGK<br>GLEWVSGIVYSGSTYYAASVKGRFTISRDNSRNTLYLQMNSLRPEDTAIYYCSAHGGESDVWGQ<br>GTTVTVSSASGGGGSGGRASGGGGSETTLTQSPATLSVSPGERATLSCRASQSVGSNLAWYQQK<br>PGQGPRLLIYGASTRATGIPARFSGSGSGTEFTLTISSLQPEDFAVYYCQQYNDWLPVTFGQGT<br>KVEIKTTTPAPRPPTPAPTIASQPLSLRPEACRPAAGGAVHTRGLDFACDIYIWAPLAGTCGVL<br>LLSLVITLYCKRGRKKLLYIFKQPFMRPVQTTQEEDGCSCRFPEEEEGGCELRVKFSRSADAPA<br>YKQGQNQLYNELNLGRREEYDVLDKRRGRDPEMGGKPRRKNPQEGLYNELQKDKMAEAYSEIGM<br>KGERRRGKGHDGLYQGLSTATKDTYDALHMQALPPR |
| 139113- nt Full CAR | 223 | ATGGCCCTCCCTGTCACCGCCCTGCTGCTTCCGCTGGCTCTTCTGCTCCACGCCGCTCGGCCCG<br>AAGTGCAATTGGTGGAAACTGGAGGAGGACTTGTGCAACCTGGAGGATCATTGCGGCTCTCATG<br>CGCTGTCTCCGGCTTCGCCCTGTCAAATCACGGGATGTCGTGGGTCAGACGGGCCCCGGGAAAG<br>GGTCTGGAATGGGTGTCGGGGATTGTGTACAGCGGCTCCACCTACTACGCCGCTTCGGTCAAGG<br>GCCGCTTCACTATTTCACGGGACAACAGCCGCAACACCCTCTATCTGCAAATGAACTCTCTCCG<br>CCCGGAGGATACCGCCATCTACTACTGCTCCGCACACGGCGGCGAATCCGACGTGTGGGGACAG<br>GGAACCACTGTCACCGTGTCGTCCGCATCCGGTGGCGGAGGATCGGGTGGCCGGGCCTCCGGGG<br>GCGGCGGCAGCGAGACTACCCTGACCCAGTCCCCTGCCACTCTGTCCGTGAGCCCGGGAGAGAG<br>AGCCACCCTTAGCTGCCGGGCCAGCCAGAGCGTGGGCTCCAACCTGGCCTGGTACCAGCAGAAG<br>CCAGGACAGGGTCCCAGGCTGCTGATCTACGGAGCCTCCACTCGCGCGACCGGCATCCCCGCGA<br>GGTTCTCCGGGTCGGGTTCCGGGACCGAGTTCACCCTGACCATCTCCTCCCTCCAACCGGAGGA<br>CTTCGCGGTGTACTACTGTCAGCAGTACAACGATTGGCTGCCCGTGACATTTGGACAGGGGACG<br>AAGGTGGAAATCAAAACCACTACCCCAGCACCGAGGCCACCCACCCCGGCTCCTACCATCGCCT<br>CCCAGCCTCTGTCCCTGCGTCCGGAGGCATGTAGACCCGCAGCTGGTGGGGCCGTGCATACCCG<br>GGGTCTTGACTTCGCCTGCGATATCTACATTTGGGCCCCTCTGGCTGGTACTTGCGGGGTCCTG<br>CTGCTTTCACTCGTGATCACTCTTTACTGTAAGCGCGGTCGGAAGAAGCTGCTGTACATCTTTA<br>AGCAACCCTTCATGAGGCCTGTGCAGACTACTCAAGAGGAGGACGGCTGTTCATGCCGGTTCCC<br>AGAGGAGGAGGAAGGCGGCTGCGAACTGCGCGTGAAATTCAGCCGCAGCGCAGATGCTCCAGCC<br>TACAAGCAGGGCCAGAACCAGCTCTACAACGAACTCAATCTTGGTCGGAGAGAGGAGTACGACG<br>TGCTGGACAAGCGGAGAGGACGGGACCCAGAAATGGGCGGGAAGCCGCGCAGAAAGAATCCCCA<br>AGAGGGCCTGTACAACGAGCTCCAAAAGGATAAGATGGCAGAAGCCTATAGCGAGATTGGTATG<br>AAAGGGGAACGCAGAAGAGGCAAAGGCCACGACGGACTGTACCAGGGACTCAGCACCGCCACCA<br>AGGACACCTATGACGCTCTTCACATGCAGGCCCTGCCGCCTCGG |

139114

| 139114- aa ScFv domain | 224 | EVQLVESGGGLVQPGGSLRLSCAVSGFALSNHGMSWVRRAPGKGLEWVSGIVYSGSTYYAASVK<br>GRFTISRDNSRNTLYLQMNSLRPEDTAIYYCSAHGGESDVWGQGTTVTVSSASGGGGSGGRASG<br>GGGSEIVLTQSPGTLSLSPGERATLSCRASQSIGSSSLAWYQQKPGQAPRLLMYGASSRASGIP<br>DRFSGSGSGTDFTLTISRLEPEDFAVYYCQQYAGSPPFTFGQGTKVEIK |
| 139114- nt ScFv domain | 225 | GAAGTGCAATTGGTGGAATCTGGTGGAGGACTTGTGCAACCTGGAGGATCACTGAGACTGTCAT<br>GCGCGGTGTCCGGTTTTGCCCTGAGCAATCATGGGATGTCGTGGGTCCGGCGCGCCCCCGGAAA |

TABLE 11-continued

Amino Acid and Nucleic Acid Sequences of the anti-BCMA scFv domains and anti-BCMA CAR molecules

| Name/ Description | SEQ ID NO: | Sequence |
|---|---|---|
| | | GGGTCTGGAATGGGTGTCGGGTATCGTCTACTCCGGGAGCACTTACTACGCCGCGAGCGTGAAG GGCCGCTTCACCATTTCCCGCGATAACTCCCGCAACACCCTGTACTTGCAAATGAACTCGCTCC GGCCTGAGGACACTGCCATCTACTACTGCTCCGCACACGGAGGAGAATCCGACGTGTGGGGCCA GGGAACTACCGTGACCGTCAGCAGCGCCTCCGGCGGCGGGGGCTCAGGCGGACGGGCTAGCGGC GGCGGTGGCTCCGAGATCGTGCTGACCCAGTCGCCTGGCACTCTCTCGCTGAGCCCCGGGGAAA GGGCAACCCTGTCCTGTCGGGCCAGCCAGTCCATTGGATCATCCTCCCTCGCCTGGTATCAGCA GAAACCGGGACAGGCTCCGCGGCTGCTTATGTATGGGGCCAGCTCAAGAGCCTCCGGCATTCCC GACCGGTTCTCCGGGTCCGGTTCCGGCACCGATTTCACCCTGACTATCTCGAGGCTGGAGCCAG AGGACTTCGCCGTGTACTACTGCCAGCAGTACGCGGGTCCCCGCCGTTCACGTTCGGACAGGG AACCAAGGTCGAGATCAAG |
| 139114- aa VH | 226 | EVQLVESGGGLVQPGGSLRLSCAVSGFALSNHGMSWVRRAPGKGLEWVSGIVYSGSTYYAASVK GRFTISRDNSRNTLYLQMNSLRPEDTAIYYCSAHGGESDVWGQTTVTVSS |
| 139114- aa VL | 227 | EIVLTQSPGTLSLSPGERATLSCRASQSIGSSSLAWYQQKPGQAPRLLMYGASSRASGIPDRFS GSGSGTDFTLTISRLEPEDFAVYYCQQYAGSPPFTFGQGTKVEIK |
| 139114- aa Full CAR | 228 | MALPVTALLLPLALLLHAARPEVQLVESGGGLVQPGGSLRLSCAVSGFALSNHGMSWVRRAPGK GLEWVSGIVYSGSTYYAASVKGRFTISRDNSRNTLYLQMNSLRPEDTAIYYCSAHGGESDVWGQ GTTVTVSSASGGGGSGGRASGGGGSEIVLTQSPGTLSLSPGERATLSCRASQSIGSSSLAWYQQ KPGQAPRLLMYGASSRASGIPDRFSGSGSGTDFTLTISRLEPEDFAVYYCQQYAGSPPFTFGQG TKVEIKTTTPAPRPPTPAPTIASQPLSLRPEACRPAAGGAVHTRGLDFACDIYIWAPLAGTCGV LLLSLVITLYCKRGRKKLLYIFKQPFMRPVQTTQEEDGCSCRFPEEEEGGCELRVKFSRSADAP AYKQGQNQLYNELNLGRREEYDVLDKRRGRDPEMGGKPRRKNPQEGLYNELQKDKMAEAYSEIG MKGERRRGKGHDGLYQGLSTATKDTYDALHMQALPPR |
| 139114- nt Full CAR | 229 | ATGGCCCTCCCTGTCACCGCCCTGCTGCTTCCGCTGGCTCTTCTGCTCCACGCCGCTCGGCCCG AAGTGCAATTGGTGGAATCTGGTGGAGGACTTGTGCAACCTGGAGGATCACTGAGACTGTCATG CGCGGTGTCCGGTTTTGCCCTGAGCAATCATGGGATGTCGTGGGTCCGGCGCGCCCCCGGAAAG GGTCTGGAATGGGTGTCGGGTATCGTCTACTCCGGGAGCACTTACTACGCCGCGAGCGTGAAGG GCCGCTTCACCATTTCCCGCGATAACTCCCGCAACACCCTGTACTTGCAAATGAACTCGCTCCG GCCTGAGGACACTGCCATCTACTACTGCTCCGCACACGGAGGAGAATCCGACGTGTGGGGCCAG GGAACTACCGTGACCGTCAGCAGCGCCTCCGGCGGCGGGGGCTCAGGCGGACGGGCTAGCGGCG GCGGTGGCTCCGAGATCGTGCTGACCCAGTCGCCTGGCACTCTCTCGCTGAGCCCCGGGGAAAG GGCAACCCTGTCCTGTCGGGCCAGCCAGTCCATTGGATCATCCTCCCTCGCCTGGTATCAGCAG AAACCGGGACAGGCTCCGCGGCTGCTTATGTATGGGGCCAGCTCAAGAGCCTCCGGCATTCCCG ACCGGTTCTCCGGGTCCGGTTCCGGCACCGATTTCACCCTGACTATCTCGAGGCTGGAGCCAGA GGACTTCGCCGTGTACTACTGCCAGCAGTACGCGGGTCCCCGCCGTTCACGTTCGGACAGGGA ACCAAGGTCGAGATCAAGACCACTACCCCAGCACCGAGGCCACCCACCCCGGCTCCTACCATCG CCTCCCAGCCTCTGTCCCTGCGTCCGGAGGCATGTAGACCCGCAGCTGGTGGGGCCGTGCATAC CCGGGGTCTTGACTTCGCCTGCGATATCTACATTTGGGCCCCTCTGGCTGGTACTTGCGGGGTC CTGCTGCTTTCACTCGTGATCACTCTTTACTGTAAGCGCGGTCGGAAGAAGCTGCTGTACATCT TTAAGCAACCCTTCATGAGGCCTGTGCAGACTACTCAAGAGGAGGACGGCTGTTCATGCCGGTT CCCAGAGGAGGAGGAAGGCGGCTGCGAACTGCGCGTGAAATTCAGCCGCAGCGCAGATGCTCCA GCCTACAAGCAGGGGCAGAACCAGCTCTACAACGAACTCAATCTTGGTCGGAGAGAGGAGTACG ACGTGCTGGACAAGCGGAGAGGACGGGACCCAGAAATGGGCGGGAAGCCGCGCAGAAAGAATCC CCAAGAGGGCCTGTACAACGAGCTCCAAAAGGATAAGATGGCAGAAGCCTATAGCGAGATTGGT ATGAAAGGGGAACGCAGAAGAGGCAAAGGCCACGACGGACTGTACCAGGGACTCAGCACCGCCA CCAAGGACACCTATGACGCTCTTCACATGCAGGCCCTGCCGCCTCGG |

149362

| 149362-aa ScFv domain | 230 | QVQLQESGPGLVKPSETLSLTCTVSGGSISSSYYYWGWIRQPPGKGLEWIGSIYYSGSAYYNPS LKSRVTISVDTSKNQFSLRLSSVTAADTAVYYCARHWQEWPDAFDIWGQGTMVTVSSGGGGSGG GGSGGGGSETTLTQSPAFMSATPGDKVIISCKASQDIDDAMNWYQQKPGEAPLFIIQSATSPVP GIPPRFSGSGFGTDFSLTINNIESEDAAYYFCLQHDNFPLTFGQGTKLEIK |
| 149362-nt ScFv domain | 231 | CAAGTGCAGCTTCAGGAAAGCGGACCGGGCCTGGTCAAGCCATCCGAAACTCTCTCCCTGACTT GCACTGTGTCTGGCGGTTCCATCTCATCGTCGTACTACTACTGGGGCTGGATTAGGCAGCCGCC CGGAAAGGGACTGGAGTGGATCGGAAGCATCTACTATTCCGGCTCGGCGTACTACAACCCTAGC CTCAAGTCGAGAGTGACCATCTCCGTGGATACCTCCAAGAACCAGTTTTCCCTGCGCCTGAGCT CCGTGACCGCCGCTGACACCGCCGTGTACTACTGTGCTCGGCATTGGCAGGAATGGCCCGATGC CTTCGACATTTGGGCCAGGGCACTATGGTCACTGTGTCATCCGGGGGTGGAGGCAGCGGGGA GGAGGGTCCGGGGGGGGAGGTTCAGAGACAACCTTGACCCAGTCACCCGCATTCATGTCCGCCA CTCCGGGAGACAAGGTCATCATCTCGTCAAAGCGTCCCAGGATATCGACGATGCCATGAATTG GTACCAGCAGAAGCCTGGCGAAGCGCCGTTCATTATCCAATCCGCAACCTCGCCCGTGCCT GGAATCCCACCGCGGTTCAGCGGCAGCGGTTTCGGAACCGACTTTTCCCTGACCATTAACAACA TTGAGTCCGAGGACGCCGCCTACTACTTCTGCCTGCAACACGACAACTTCCCTCTCACGTTCGG CCAGGGAACCAAGCTGGAAATCAAG |
| 149362-aa VH | 232 | QVQLQESGPGLVKPSETLSLTCTVSGGSISSSYYYWGWIRQPPGKGLEWIGSIYYSGSAYYNPS LKSRVTISVDTSKNQFSLRLSSVTAADTAVYYCARHWQEWPDAFDIWGQGTMVTVSS |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| 149362-aa VL | 233 | ETTLTQSPAFMSATPGDKVIISC<u>KASQDIDDAMN</u>WYQQKPGEAPLFIIQ<u>SATSPVP</u>GIPPRFSG SGFGTDFSLTINNIESEDAAYYFC<u>LQHDNFPLT</u>FGQGTKLEIK |
| 149362-aa Full CAR | 234 | MALPVTALLLPLALLLHAARPQVQLQESGPGLVKPSETLSLTCTVS<u>GGSISSSYYYW</u>GWIRQPP GKGLEWIGS<u>IYYSGSAYYNPSLKS</u>RVTISVDTSKNQFSLRLSSVTA<u>ADTAVYYCARHWQEWPDA FDI</u>WGQGTMVTVSSGGGGSGGGGSGGGGSETTLTQSPAFMSATPGDKVIISC<u>KASQDIDDAMNW</u> YQQKPGEAPLFIIQ<u>SATSPVP</u>GIPPRFSGSGFGTDFSLTINNIESEDAAYYFC<u>LQHDNFPLT</u>FG QGTKLEIKTTTPAPRPPTPAPTIASQPLSLRPEACRPAAGGAVHTRGLDFACDIYIWAPLAGTC GVLLLSLVITLYCKRGRKKLLYIFKQPFMRPVQTTQEEDGCSCRFPEEEEGGCELRVKFSRSAD APAYKQGQNQLYNELNLGRREEYDVLDKRRGRDPEMGGKPRRKNPQEGLYNELQKDKMAEAYSE IGMKGERRRGKGHDGLYQGLSTATKDTYDALHMQALPPR |
| 149362-nt Full CAR | 235 | ATGGCCCTCCCTGTCACCGCCCTGCTGCTTCCGCTGGCTCTTCTGCTCCACGCCGCTCGGCCCC AAGTGCAGCTTCAGGAAAGCGGACCGGGCCTGGTCAAGCCATCCGAAACTCTCTCCCTGACTTG CACTGTGTCTGGCGGTTCCATCTCATCGTCGTACTACTACTGGGGCTGGATTAGGCAGCCGCCC GGAAAGGGACTGGAGTGGATCGGAAGCATCTACTATTCCGGCTCGGCTACTACAACCCTAGCC TCAAGTCGAGAGTGACCATCTCCGTGGATACCTCCAAGAACCAGTTTTCCCTGCGCCTGAGCTC CGTGACCGCCGCTGACACCGCCGTGTACTACTGTGCTCGGCATTGGCAGGAATGGCCCGATGCC TTCGACATTTGGGGCCAGGGCACTATGGTCACTGTGTCATCCGGGGGTGGAGGCAGCGGGGGAG GAGGGTCCGGGGGGGGAGGTTCAGAGACAACCTTGACCCAGTCACCCGCATTCATGTCCGCCAC TCCGGGAGACAAGGTCATCATCTCGTGCAAAGCGTCCCAGGATATCGACGATGCCATGAATTGG TACCAGCAGAAGCCTGGCGAAGCGCCGCTGTTCATTATCCAATCCGCAACCTCGCCCGTGCCTG GAATCCCACCGCGGTTCAGCGGCAGCGGTTTCGGAACCGACTTTTCCCTGACCATTAACAACAT TGAGTCCGAGGACGCCGCCTACTACTTCTGCCTGCAACACGACAACTTCCCTCTCACGTTCGGC CAGGGGAACCAAGCTGGAAATCAAGACCACTACCCCAGCACCGAGGCCACCCACCCCGGCTCCTA CCATCGCCTCCCAGCCTCTGTCCCTGCGTCCGGAGGCATGTAGACCCGCAGCTGGTGGGGCCGT GCATACCCGGGGTCTTGACTTCGCCTGCGATATCTACATTTGGGCCCCTCTGGCTGGTACTTGC GGGGTCCTGCTGCTTTCACTCGTGATCACTCTTTACTGTAAGCGCGGTCGGAAGAAGCTGCTGT ACATCTTTAAGCAACCCTTCATGAGGCCTGTGCAGACTACTCAAGAGGAGGACGGCTGTTCATG CCGGTTCCCAGAGGAGGAGGAAGGCGGCTGCGAACTGCGCGTGAAATTCAGCCGCAGCGCAGAT GCTCCAGCCTACAAGCAGGGGCAGAACCAGCTCTACAACGAACTCAATCTTGGTCGGAGAGAGG AGTACGACGTGCTGGACAAGCGGAGAGGACGGGACCCAGAAATGGGCGGGAAGCCGCGCAGAAA GAATCCCCAAGAGGGCCTGTACAACGAGCTCCAAAAGGATAAGATGGCAGAAGCCTATAGCGAG ATTGGTATGAAAGGGGAACGCAGAAGAGGCAAAGGCCACGACGGACTGTACCAGGGACTCAGCA CCGCCACCAAGGACACCTATGACGCTCTTCACATGCAGGCCCTGCCGCCTCGG |

149363

| | | |
|---|---|---|
| 149363-aa ScFv domain | 236 | VNLRESGPALVKPTQTLTLTCTFS<u>GFSLRTSGMCVS</u>WIRQPPGKALEWLA<u>RIDWDEDKFYSTSL KT</u>RLTISKDTSDNQVVLRMTNMDP<u>ADTATYYCARSGAGGTSATAFDI</u>WGPGTMVTVSSGGGGSG GGGSGGGGSDIQMTQSPSSLSASVGDRVTITC<u>RASQDIYNNLA</u>WFQLKPGSAPRSLMY<u>AANKSQ</u> SGVPSRFSGSASGTDFTLTISSLQPEDFATYYC<u>QHYYRFPYSF</u>GQGTKLEIK |
| 149363-nt ScFv domain | 237 | CAAGTCAATCTGCGCGAATCCGGCCCCGCCTTGGTCAAGCCTACCCAGACCCTCACTCTGACCT GTACTTTCTCCGGCTTCTCCCTGCGACTTCCGGGATGTGCGTGTCCTGGATCAGACAGCCTCC GGGAAAGGCCCTGGAGTGGCTCGCTCGCATTGACTGGGATGAGGACAAGTTCTACTCCACCTCA CTCAAGACCAGGCTGACCATCAGCAAAGATACCTCTGACAACCAAGTGGTGCTCCGCATGACCA ACATGGACCCAGCCGACACTGCCACTTACTACTGCGCGAGGAGCGGAGCGGGCGGAACCTCCGC CACCGCCTTCGATATTTGGGGCCCGGGTACCATGGTCACCGTGTCAAGCGGAGGAGGGGGGTCC GGGGGCGGCGGTTCCGGGGGGAGGCGGATCGGACATTCAGATGACTCAGTCACCATCGTCCCTGA GCGCTAGCGTGGGCGACAGAGTGACAATCACTTGCCGGGCATCCCAGGACATCTATAACAACCT TGCGTGGTTCCAGCTGAAGCCTGGTTCCGCACCGCGGTCACTTATGTACGCCGCCAACAAGAGC CAGTCGGGAGTGCCGTCCCGGTTTTCCGGTTCGGCCTCGGGAACTGACTTCACCCTGACGATCT CCAGCCTGCAACCCGAGGATTTCGCCACCTACTACTGCCAGCACTACTACCGCTTTCCCTACTC GTTCGGACAGGGAACCAAGCTGGAAATCAAG |
| 149363-aa VH | 238 | QVNLRESGPALVKPTQTLTLTCTFS<u>GFSLRTSGMCVS</u>WIRQPPGKALEWLA<u>RIDWDEDKFYSTS LKT</u>RLTISKDTSDNQVVLRMTNMDP<u>ADTATYYCARSGAGGTSATAFDI</u>WGPGTMVTVSS |
| 149363-aa VL | 239 | DIQMTQSPSSLSASVGDRVTITC<u>RASQDIYNNLA</u>WFQLKPGSAPRSLMY<u>AANKSQ</u>SGVPSRFSG SASGTDFTLTISSLQPEDFATYYC<u>QHYYRFPYS</u>FGQGTKLEIK |
| 149363-aa Full CAR | 240 | MALPVTALLLPLALLLHAARPQVNLRESGPALVKPTQTLTLTCTFS<u>GFSLRTSGMCVS</u>WIRQPP GKALEWLA<u>RIDWDEDKFYSTSLKT</u>RLTISKDTSDNQVVLRMTNMDP<u>ADTATYYCARSGAGGTSA TAFDI</u>WGPGTMVTVSSGGGGSGGGGSGGGGSDIQMTQSPSSLSASVGDRVTITC<u>RASQDIYNNL AW</u>FQLKPGSAPRSLMY<u>AANKSQ</u>SGVPSRFSGSASGTDFTLTISSLQPEDFATYYC<u>QHYYRFPYS </u>FGQGTKLEIKTTTPAPRPPTPAPTIASQPLSLRPEACRPAAGGAVHTRGLDFACDIYIWAPLAG TCGVLLLSLVITLYCKRGRKKLLYIFKQPFMRPVQTTQEEDGCSCRFPEEEEGGCELRVKFSRS ADAPAYKQGQNQLYNELNLGRREEYDVLDKRRGRDPEMGGKPRRKNPQEGLYNELQKDKMAEAY SEIGMKGERRRGKGHDGLYQGLSTATKDTYDALHMQALPPR |
| 149363-nt Full CAR | 241 | ATGGCCCTCCCTGTCACCGCCCTGCTGCTTCCGCTGGCTCTTCTGCTCCACGCCGCTCGGCCCC AAGTCAATCTGCGCGAATCCGGCCCCGCCTTGGTCAAGCCTACCCAGACCCTCACTCTGACCTG |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| | | TACTTTCTCCGGCTTCTCCCTGCGGACTTCCGGGATGTGCGTGTCCTGGATCAGACAGCCTCCG<br>GGAAAGGCCCTGGAGTGGCTCGCTCGCATTGACTGGGATGAGGACAAGTTCTACTCCACCTCAC<br>TCAAGACCAGGCTGACCATCAGCAAAGATACCTCTGACAACCAAGTGGTGCTCCGCATGACCAA<br>CATGGACCCAGCCGACACTGCCACTTACTACTGCGCGAGGAGCGGAGCGGGCGGAACCTCCGCC<br>ACCGCCTTCGATATTTGGGGCCCGGGTACCATGGTCACCGTGTCAAGCGGAGGAGGGGGTCCG<br>GGGGCGGCGGTTCCGGGGGAGGCGGATCGGACATTCAGATGACTCAGTCACCATCGTCCCTGAG<br>CGCTAGCGTGGGCGACAGAGTGACAATCACTTGCCGGGCATCCCAGGACATCTATAACAACCTT<br>GCGTGGTTCCAGCTGAAGCCTGGTTCCGCACCGCGGTCACTTATGTACGCCGCCAACAAGAGCC<br>AGTCGGGAGTGCCGTCCCGGTTTTCCGGTTCGGCCTCGGGAACTGACTTCACCCTGACGATCTC<br>CAGCCTGCAACCCGAGGATTTCGCCACCTACTACTGCCAGCACTACTACCGCTTTCCCTACTCG<br>TTCGGACAGGGAACCAAGCTGGAAATCAAGACCACTACCCCAGCACCGAGGCCACCCACCCCGG<br>CTCCTACCATCGCCTCCCAGCCTCTGTCCCTGCGTCCGGAGGCATGTAGACCCGCAGCTGGTGG<br>GGCCGTGCATACCCGGGGTCTTGACTTCGCCTGCGATATCTACATTTGGGCCCCTCTGGCTGGT<br>ACTTGCGGGGTCCTGCTGCTTTCACTCGTGATCACTCTTTACTGTAAGCGCGGTCGGAAGAAGC<br>TGCTGTACATCTTTAAGCAACCCTTCATGAGGCCTGTGCAGACTACTCAAGAGGAGGACGGCTG<br>TTCATGCCGGTTCCCAGAGGAGGAGGAAGGCGGCTGCGAACTGCGCGTGAAATTCAGCCGCAGC<br>GCAGATGCTCCAGCCTACAAGCAGGGCAGAACCAGCTCTACAACGAACTCAATCTTGGTCGGA<br>GAGAGGAGTACGACGTGCTGGACAAGCGGAGGACGGGACCCAGAAATGGGCGGGAAGCCGCG<br>CAGAAAGAATCCCCAAGAGGGCCTGTACAACGAGCTCCAAAAGGATAAGATGGCAGAAGCCTAT<br>AGCGAGATTGGTATGAAAGGGGAACGCAGAAGAGGCAAAGGCCACGACGGACTGTACCAGGGAC<br>TCAGCACCGCCACCAAGGACACCTATGACGCTCTTCACATGCAGGCCCTGCCGCCTCGG |
| | | 149364 |
| 149364-aa ScFv domain | 242 | EVQLVESGGGLVKPGGSLRLSCAASGFTFSSYSMNWVRQAPGKGLEWVSSISSSSSYIYYADSV<br>KGRFTISRDNAKNSLYLQMNSLRAEDTAVYYCAKTIAAVYAFDIWGQGTTVTVSSGGGGSGGGG<br>SGGGGSEIVLTQSPLSLPVTPEEPASISCRSSQSLLHSNGYNYLDWYLQKPGQSPQLLIYLGSN<br>RASGVPDRFSGSGSGTDFTLKISRVEAEDVGVYYCMQALQTPYTFGQGTKLEIK |
| 149364-nt ScFv domain | 243 | GAAGTGCAGCTTGTCGAATCCGGGGGGGACTGGTCAAGCCGGCGGATCACTGAGACTGTCCT<br>GCGCCGCGAGCGGCTTCACGTTCTCCTCCTACTCCATGAACTGGGTCCGCCAAGCCCCCGGGAA<br>GGGACTGGAATGGGTGTCCTCTATCTCCTCGTCGTCGTCCTACATCTACTACGCCGACTCCGTG<br>AAGGGAAGATTCACCATTTCCCGCGACAACGCAAAGAACTCACTGTACTTGCAAATGAACTCAC<br>TCCGGGCCGAAGATACTGCTGTGTACTATTGCGCCAAGACTATTGCCGCCGTCTACGCTTTCGA<br>CATCTGGGGCCAGGGAACCACCGTGACTGTGTCGTCCGGTGGTGGTGGCTCGGGCGGAGGAGGA<br>AGCGGCGGCGGGGGGTCCGAGATTGTGCTGACCCAGTCGCCACTGAGCCTCCCTGTGACCCCCG<br>AGGAACCCGCCAGCATCAGCTGCCGGTCCAGCCAGTCCCTGCTCCACTCCAACGGATACAATTA<br>CCTCGATTGGTACCTTCAGAAGCCTGGACAAAGCCCGCAGCTGCTCATCTACTTGGGATCAAAC<br>CGCGCGTCAGGAGTGCCTGACCGGTTCTCCGGCTCGGGCAGCGGTACCGATTTCACCCTGAAAA<br>TCTCCAGGGTGGAGGCAGAGGACGTGGGAGTGTATTACTGTATGCAGGCGCTGCAGACTCCGTA<br>CACATTTGGGCAGGGCACCAAGCTGGAGATCAAG |
| 149364-aa VH | 244 | EVQLVESGGGLVKPGGSLRLSCAASGFTFSSYSMNWVRQAPGKGLEWVSSISSSSSYIYYADSV<br>KGRFTISRDNAKNSLYLQMNSLRAEDTAVYYCAKTIAAVYAFDIWGQGTTVTVSS |
| 149364-aa VL | 245 | EIVLTQSPLSLPVTPEEPASISCRSSQSLLHSNGYNYLDWYLQKPGQSPQLLIYLGSNRASGVP<br>DRFSGSGSGTDFTLKISRVEAEDVGVYYCMQALQTPYTFGQGTKLEIK |
| 149364-aa Full CAR | 246 | MALPVTALLLPLALLLHAARPEVQLVESGGGLVKPGGSLRLSCAASGFTFSSYSMNWVRQAPGK<br>GLEWVSSISSSSSYIYYADSVKGRFTISRDNAKNSLYLQMNSLRAEDTAVYYCAKTIAAVYAFD<br>IWGQGTTVTVSSGGGGSGGGGSGGGGSEIVLTQSPLSLPVTPEEPASISCRSSQSLLHSNGYNY<br>LDWYLQKPGQSPQLLIYLGSNRASGVPDRFSGSGSGTDFTLKISRVEAEDVGVYYCMQALQTPY<br>TFGQGTKLEIKTTTPAPRPPTPAPTIASQPLSLRPEACRPAAGGAVHTRGLDFACDIYIWAPLA<br>GTCGVLLLSLVITLYCKRGRKKLLYIFKQPFMRPVQTTQEEDGCSCRFPEEEEGGCELRVKFSR<br>SADAPAYKQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 149364-nt Full CAR | 247 | ATGGCCCTCCCTGTCACCGCCCTGCTGCTTCCGCTGGCTCTTCTGCTCCACGCCGCTCGGCCCG<br>AAGTGCAGCTTGTCGAATCCGGGGGGGACTGGTCAAGCCGGCGGATCACTGAGACTGTCCTG<br>CGCCGCGAGCGGCTTCACGTTCTCCTCCTACTCCATGAACTGGGTCCGCCAAGCCCCCGGGAAG<br>GGACTGGAATGGGTGTCCTCTATCTCCTCGTCGTCGTCCTACATCTACTACGCCGACTCCGTGA<br>AGGGAAGATTCACCATTTCCCGCGACAACGCAAAGAACTCACTGTACTTGCAAATGAACTCACT<br>CCGGGCCGAAGATACTGCTGTGTACTATTGCGCCAAGACTATTGCCGCCGTCTACGCTTTCGAC<br>ATCTGGGGCCAGGGAACCACCGTGACTGTGTCGTCCGGTGGTGGTGGCTCGGGCGGAGGAGGAA<br>GCGGCGGCGGGGGGTCCGAGATTGTGCTGACCCAGTCGCCACTGAGCCTCCCTGTGACCCCCGA<br>GGAACCCGCCAGCATCAGCTGCCGGTCCAGCCAGTCCCTGCTCCACTCCAACGGATACAATTAC<br>CTCGATTGGTACCTTCAGAAGCCTGGACAAAGCCCGCAGCTGCTCATCTACTTGGGATCAAACC<br>GCGCGTCAGGAGTGCCTGACCGGTTCTCCGGCTCGGGCAGCGGTACCGATTTCACCCTGAAAAT<br>CTCCAGGGTGGAGGCAGAGGACGTGGGAGTGTATTACTGTATGCAGGCGCTGCAGACTCCGTAC<br>ACATTTGGGCAGGGCACCAAGCTGGAGATCAAGACCACTACCCCAGCACCGAGGCCACCCACCC<br>CGGCTCCTACCATCGCCTCCCAGCCTCTGTCCCTGCGTCCGGAGGCATGTAGACCCGCAGCTGG<br>TGGGGCCGTGCATACCCGGGGTCTTGACTTCGCCTGCGATATCTACATTTGGGCCCCTCTGGCT<br>GGTACTTGCGGGGTCCTGCTGCTTTCACTCGTGATCACTCTTTACTGTAAGCGCGGTCGGAAGA |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| | | AGCTGCTGTACATCTTTAAGCAACCCTTCATGAGGCCTGTGCAGACTACTCAAGAGGAGGACGG<br>CTGTTCATGCCGGTTCCCAGAGGAGGAGGAAGGCGGCTGCGAACTGCGCGTGAAATTCAGCCGC<br>AGCGCAGATGCTCCAGCCTACAAGCAGGGGCAGAACCAGCTCTACAACGAACTCAATCTTGGTC<br>GGAGAGAGGAGTACGACGTGCTGGACAAGCGGAGAGGACGGGACCCAGAAATGGGCGGGAAGCC<br>GCGCAGAAAGAATCCCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGACGGACTGTACCAGG<br>GACTCAGCACCGCCACCAAGGACACCTATGACGCTCTTCACATGCAGGCCCTGCCGCCTCGG |

149365

| 149365-aa ScFv domain | 248 | EVQLVESGGGLVKPGGSLRLSCAASGFTFSDYYMSWIRQAPGKGLEWVSYISSSGSTIYYADSV<br>KGRFTISRDNAKNSLYLQMNSLRAEDTAVYYCARDLRGAFDIWGQGTMVTVSSGGGGSGGGGSG<br>GGGSSYVLTQSPSVSAAPGYTATISCGGNNIGTKSVHWYQQKPGQAPLLVIRDDSVRPSKIPGR<br>FSGSNSGNMATLTISGVQAGDEADFYCQVWDSDSEHVVFGGGTKLTVL |
| 149365-nt ScFv domain | 249 | GAAGTCCAGCTCGTGGAGTCCGGCGGAGGCCTTGTGAAGCCTGGAGGTTCGCTGAGACTGTCCT<br>GCGCCGCCTCCGGCTTCACCTTCTCCGACTACTACATGTCCTGGATCAGACAGGCCCCGGGAAA<br>GGGCCTGGAATGGGTGTCCTACATCTCGTCATCGGGCAGCACTATCTACTACGCGGACTCAGTG<br>AAGGGGCGGTTCACCATTTCCCGGGATAACGCGAAGAACTCGCTGTATCTGCAAATGAACTCAC<br>TGAGGGCCGAGGACACCGCCGTGTACTACTGCGCCCGCGATCTCCGCGGGGCATTTGACATCTG<br>GGGACAGGGAACCATGGTCACAGTGTCCAGCGGAGGGGGAGGATCGGGTGGCGGAGGTTCCGGG<br>GGTGGAGGCTCCTCCTACGTGCTGACTCAGAGCCCAAGCGTCAGCGCTGCGCCCGGTTACACGG<br>CAACCATCTCCTGTGGCGGAAACAACATTGGGACCAAGTCTGTGCACTGGTATCAGCAGAAGCC<br>GGGCCAAGCTCCCCTGTTGGTGATCCGCGATGACTCCGTGCGGCCTAGCAAAATTCCGGGACGG<br>TTCTCCGGCTCCAACAGCGGCAATATGGCCACTCTCACCATCTCGGGAGTGCAGGCCGGAGATG<br>AAGCCGACTTCTACTGCCAAGTCTGGGACTCAGACTCCGAGCATGTGGTGTTCGGGGGCGGAAC<br>CAAGCTGACTGTGCTC |
| 149365-aa VH | 250 | EVQLVESGGGLVKPGGSLRLSCAASGFTFSDYYMSWIRQAPGKGLEWVSYISSSGSTIYYADSV<br>KGRFTISRDNAKNSLYLQMNSLRAEDTAVYYCARDLRGAFDIWGQGTMVTVSS |
| 149365-aa VL | 251 | SYVLTQSPSVSAAPGYTATISCGGNNIGTKSVHWYQQKPGQAPLLVIRDDSVRPSKIPGRFSGS<br>NSGNMATLTISGVQAGDEADFYCQVWDSDSEHVVFGGGTKLTVL |
| 149365-aa Full CAR | 252 | MALPVTALLLPLALLLHAARPEVQLVESGGGLVKPGGSLRLSCAASGFTFSDYYMSWIRQAPGK<br>GLEWVSYISSSGSTIYYADSVKGRFTISRDNAKNSLYLQMNSLRAEDTAVYYCARDLRGAFDIW<br>GQGTMVTVSSGGGGSGGGGSGGGGSSYVLTQSPSVSAAPGYTATISCGGNNIGTKSVHWYQQKP<br>GQAPLLVIRDDSVRPSKIPGRFSGSNSGNMATLTISGVQAGDEADFYCQVWDSDSEHVVFGGGT<br>KLTVLTTTPAPRPPTPAPTIASQPLSLRPEACRPAAGGAVHTRGLDFACDIYIWAPLAGTCGVL<br>LLSLVITLYCKRGRKKLLYIFKQPFMRPVQTTQEEDGCSCRFPEEEEGGCELRVKFSRSADAPA<br>YKQGQNQLYNELNLGRREEYDVLDKRRGRDPEMGGKPRRKNPQEGLYNELQKDKMAEAYSEIGM<br>KGERRRGKGHDGLYQGLSTATKDTYDALHMQALPPR |
| 149365-nt Full CAR | 253 | ATGGCCCTCCCTGTCACCGCCCTGCTGCTTCCGCTGGCTCTTCTGCTCCACGCCGCTCGGCCCG<br>AAGTCCAGCTCGTGGAGTCCGGCGGAGGCCTTGTGAAGCCTGGAGGTTCGCTGAGACTGTCCTG<br>CGCCGCCTCCGGCTTCACCTTCTCCGACTACTACATGTCCTGGATCAGACAGGCCCCGGGAAAG<br>GGCCTGGAATGGGTGTCCTACATCTCGTCATCGGGCAGCACTATCTACTACGCGGACTCAGTGA<br>AGGGGCGGTTCACCATTTCCCGGGATAACGCGAAGAACTCGCTGTATCTGCAAATGAACTCACT<br>GAGGGCCGAGGACACCGCCGTGTACTACTGCGCCCGCGATCTCCGCGGGGCATTTGACATCTGG<br>GGACAGGGAACCATGGTCACAGTGTCCAGCGGAGGGGGAGGATCGGGTGGCGGAGGTTCCGGGG<br>GTGGAGGCTCCTCCTACGTGCTGACTCAGAGCCCAAGCGTCAGCGCTGCGCCCGGTTACACGGC<br>AACCATCTCCTGTGGCGGAAACAACATTGGGACCAAGTCTGTGCACTGGTATCAGCAGAAGCCG<br>GGCCAAGCTCCCCTGTTGGTGATCCGCGATGACTCCGTGCGGCCTAGCAAAATTCCGGGACGGT<br>TCTCCGGCTCCAACAGCGGCAATATGGCCACTCTCACCATCTCGGGAGTGCAGGCCGGAGATGA<br>AGCCGACTTCTACTGCCAAGTCTGGGACTCAGACTCCGAGCATGTGGTGTTCGGGGGCGGAACC<br>AAGCTGACTGTGCTCACCACTACCCCAGCACCGAGGCGACCCACCCCGGCTCCTACCATCGCCT<br>CCCAGCCTCTGTCCCTGCGTCCGAGGCATGTAGACCCGCAGCTGGTGGGGCCGTGCATACCCG<br>GGGTCTTGACTTCGCCTGCGATATCTACATTTGGGCCCCTCTGGCTGGTACTTGCGGGGTCCTG<br>CTGCTTTCACTCGTGATCACTCTTTACTGTAAGCGCGGTCGGAAGAAGCTGCTGTACATCTTTA<br>AGCAACCCTTCATGAGGCCTGTGCAGACTACTCAAGAGGAGGACGGCTGTTCATGCCGGTTCCC<br>AGAGGAGGAGGAAGGCGGCTGCGAACTGCGCGTGAAATTCAGCCGCAGCGCAGATGCTCCAGCC<br>TACAAGCAGGGGCAGAACCAGCTCTACAACGAACTCAATCTTGGTCGGAGAGAGGAGTACGACG<br>TGCTGGACAAGCGGAGAGGACGGGACCCAGAAATGGGCGGGAAGCCGCGCAGAAAGAATCCCCA<br>AGAGGGCCTGTACAACGAGCTCCAAAAGGATAAGATGGCAGAAGCCTATAGCGAGATTGGTATG<br>AAAGGGGAACGCAGAAGAGGCAAAGGCCACGACGGACTGTACCAGGGACTCAGCACCGCCACCA<br>AGGACACCTATGACGCTCTTCACATGCAGGCCCTGCCGCCTCGG |

149366

| 149366-aa ScFv domain | 254 | QVQLVQSGAEVKKPGASVKVSCKPSGYTVTSHYIHWVRRAPGQGLEWMGMINPSGGVTAYSQTL<br>QGRVTMTSDTSSSTVYMELSSLRSEDTAMYYCAREGSGSGWYFDFWGRGTLVTVSSGGGGSGGG<br>GSGGGGSSYVLTQPPSVSPGQTASITCSGDGLSKKYVSWYQQKAGQSPVVLISRDKERPSGI<br>PDRFSGSNSADTATLTISGTQAMDEADYYCQAWDDTTVVFGGGTKLTVL |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| 149366-nt ScFv domain | 255 | CAAGTGCAGCTGGTGCAGAGCGGGGCCGAAGTCAAGAAGCCGGGAGCCTCCGTGAAAGTGTCCT<br>GCAAGCCTTCGGGATACACCGTGACCTCCCACTACATTCATTGGGTCCGCCGCGCCCCCGGCCA<br>AGGACTCGAGTGGATGGGCATGATCAACCCTAGCGGCGGAGTGACCGCGTACAGCCAGACGCTG<br>CAGGGACGCGTGACTATGACCTCGGATACCTCCTCCTCCACCGTCTATATGGAACTGTCCAGCC<br>TGCGGTCCGAGGATACCGCCATGTACTACTGCGCCCGGGAAGGATCAGGCTCCGGGTGGTATTT<br>CGACTTCTGGGGAAGAGGCACCCTCGTGACTGTGTCATCTGGGGGAGGGGGTTCCGGTGGTGGC<br>GGATCGGGAGGAGGCGGTTCATCCTACGTGCTGACCCAGCCACCCTCCGTGTCCGTGAGCCCCG<br>GCCAGACTGCATCGATTACATGTAGCGGCGACGGCCTCTCCAAGAAATACGTGTCGTGGTACCA<br>GCAGAAGGCCGGACAGAGCCCGGTGGTGCTGATCTCAAGAGATAAGGAGCGGCCTAGCGGAATC<br>CCGGACAGGTTCTCGGGTTCCAACTCCGCGGACACTGCTACTCTGACCATCTCGGGGACCCAGG<br>CTATGGACGAAGCCGATTACTACTGCCAAGCCTGGGACGACACTACTGTCGTGTTTGGAGGGGG<br>CACCAAGTTGACCGTCCTT |
| 149366-aa VH | 256 | QVQLVQSGAEVKKPGASVKVSCKPSGYTVTSHYIHWVRRAPGQGLEWMGMINPSGGVTAYSQTL<br>QGRVTMTSDTSSSTVYMELSSLRSEDTAMYYCAREGSGSGWYFDFWGRGTLVTVSS |
| 149366-aa VL | 257 | SYVLTQPPSVSVSPGQTASITCSGDGLSKKYVSWYQQKAGQSPVVLISRDKERPSGIPDRFSGS<br>NSADTATLTISGTQAMDEADYYCQAWDDTTVVFGGGTKLTVL |
| 149366-aa Full CAR | 258 | MALPVTALLLPLALLLHAARPQVQLVQSGAEVKKPGASVKVSCKPSGYTVTSHYIHWVRRAPGQ<br>GLEWMGMINPSGGVTAYSQTLQGRVTMTSDTSSSTVYMELSSLRSEDTAMYYCAREGSGSGWYF<br>DFWGRGTLVTVSSGGGGSGGGGSGGGGSSYVLTQPPSVSVSPGQTASITCSGDGLSKKYVSWYQ<br>QKAGQSPVVLISRDKERPSGIPDRFSGSNSADTATLTISGTQAMDEADYYCQAWDDTTVVFGGG<br>TKLTVLTTTPAPRPPTPAPTIASQPLSLRPEACRPAAGGAVHTRGLDFACDIYIWAPLAGTCGV<br>LLLSLVITLYCKRGRKKLLYIFKQPFMRPVQTTQEEDGCSCRFPEEEEGGCELRVKFSRSADAP<br>AYKQGQNQLYNELNLGRREEYDVLDKRRGRDPEMGGKPRRKNPQEGLYNELQKDKMAEAYSEIG<br>MKGERRRGKGHDGLYQGLSTATKDTYDALHMQALPPR |
| 149366-nt Full CAR | 259 | ATGGCCCTCCCTGTCACCGCCCTGCTGCTTCCGCTGGCTCTTCTGCTCCACGCCGCTCGGCCCC<br>AAGTGCAGCTGGTGCAGAGCGGGGCCGAAGTCAAGAAGCCGGGAGCCTCCGTGAAAGTGTCCTG<br>CAAGCCTTCGGGATACACCGTGACCTCCCACTACATTCATTGGGTCCGCCGCGCCCCCGGCCAA<br>GGACTCGAGTGGATGGGCATGATCAACCCTAGCGGCGGAGTGACCGCGTACAGCCAGACGCTGC<br>AGGGACGCGTGACTATGACCTCGGATACCTCCTCCTCCACCGTCTATATGGAACTGTCCAGCCT<br>GCGGTCCGAGGATACCGCCATGTACTACTGCGCCCGGGAAGGATCAGGCTCCGGGTGGTATTTC<br>GACTTCTGGGGAAGAGGCACCCTCGTGACTGTGTCATCTGGGGGAGGGGGTTCCGGTGGTGGCG<br>GATCGGGAGGAGGCGGTTCATCCTACGTGCTGACCCAGCCACCCTCCGTGTCCGTGAGCCCCGG<br>CCAGACTGCATCGATTACATGTAGCGGCGACGGCCTCTCCAAGAAATACGTGTCGTGGTACCAG<br>CAGAAGGCCGGACAGAGCCCGGTGGTGCTGATCTCAAGAGATAAGGAGCGGCCTAGCGGAATCC<br>CGGACAGGTTCTCGGGTTCCAACTCCGCGGACACTGCTACTCTGACCATCTCGGGGACCCAGGC<br>TATGGACGAAGCCGATTACTACTGCCAAGCCTGGGACGACACTACTGTCGTGTTTGGAGGGGGC<br>ACCAAGTTGACCGTCCTTACCACTACCCCAGCACCGAGGCCACCCACCCCGGCTCCTACCATCG<br>CCTCCCAGCCTCTGTCCCTGCGTCCGGAGGCATGTAGACCCGCAGCTGGTGGGGCCGTGCATAC<br>CCGGGGTCTTGACTTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAGCTGCTGTACATCT<br>TTAAGCAACCCTTCATGAGGCCTGTGCAGACTACTCAAGAGGAGGACGGCTGTTCATGCCGGTT<br>CCCAGAGGAGGAGGAAGGCGGCTGCGAACTGCGCGTGAAATTCAGCCGCAGCGCAGATGCTCCA<br>GCCTACAAGCAGGGGCAGAACCAGCTCTACAACGAACTCAATCTTGGTCGGAGAGAGGAGTACG<br>ACGTGCTGGACAAGCGGAGAGGACGGGACCCAGAAATGGGCGGGAAGCCGCGCAGAAAGAATCC<br>CCAAGAGGGCCTGTACAACGAGCTCCAAAAGGATAAGATGGCAGAAGCCTATAGCGAGATTGGT<br>ATGAAAGGGGAACGCAGAAGAGGCAAAGGCCACGACGGACTGTACCAGGGACTCAGCACCGCCA<br>CCAAGGACACCTATGACGCTCTTCACATGCAGGCCCTGCCGCCTCGG |

149367

| 149367-aa ScFv domain | 260 | QVQLQESGPGLVKPSQTLSLTCTVSGGSISSGGYYWSWIRQHPGKGLEWIGYIYYSGSTYYNPS<br>LKSRVTISVDTSKNQFSLKLSSVTAADTAVYYCARAGIAARLRGAFDIWGQGTMVTVSSGGGGS<br>GGGGSGGGGSDIVMTQSPSSVSASVGDRVIITCRASQGIRNWLAWYQQKPGKAPNLLIYAASNL<br>QSGVPSRFSGSGSGADFTLTISSLQPEDVATYYCQKYNSAPFTFGPGTKVDIK |
| 149367-nt ScFv domain | 261 | CAAGTGCAGCTTCAGGAGAGCGGCCCGGGACTCGTGAAGCCGTCCCAGACCCTGTCCCTGACTT<br>GCACCGTGTCGGGAGGAAGCATCTCGAGCGGAGGCTACTATTGGTCGTGGATTCGGCAGCACCC<br>TGGAAAGGGCCTGGAATGGATCGGCTACATCTACTACTCCGGCTCGACCTACTACAACCCATCG<br>CTGAAGTCCAGAGTGACAATCTCAGTGGACACGTCCAAGAATCAGTTCAGCCTGAAGCTCTCTT<br>CCGTGACTGCGGCCGACACCGCCGTGTACTACTGCGCACGCGCTGGAATTGCCGCCCGGCTGAG<br>GGGTGCCTTCGACATTTGGGACAGGGCACCATGGTCACCGTGTCCTCCGGCGGCGGAGGTTCC<br>GGGGGTGGAGGCTCAGGAGGAGGGGGTCCGACATCGTCATGACTCAGTCGCCCTCAAGCGTCA<br>GCGCGTCCGTCGGGGACAGGGTGATCATCACCTGTCGCGCCAGCCAGGGAATTCGCAACTGGCT<br>GGCCTGGTATCAGCAGAAGCCCGGAAAGGCCCCCAACCTGTTGATCTACGCCGCCTCAAACCTC<br>CAATCCGGGGTGCCGAGCCGCTTCAGCGGCTCCGGTTCGGGTGCCGATTTCACTCTGACCATCT<br>CCTCCCTGCAACCTGAAGATGTGGCTACCTACTACTGCCAAAAGTACAACTCCGCACCTTTTAC<br>TTTCGGACCGGGGACCAAAGTGGACATTAAG |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| 149367-aa VH | 262 | QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS |
| 149367-aa VL | 263 | DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK |
| 149367-aa Full CAR | 264 | MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 149367-nt Full CAR | 265 | ATGGCCCTCCCTGTCACCGCCCTGCTGCTTCCGCTGGCTCTTCTGCTCCACGCGCTCGGCCCCAAGTGCAGCTTCAGGAGAGCGGCCCGGGACTCGTGAAGCCGTCCCAGACCCTGTCCCTGACTTGCACCGTGTCGGGAGGAAGCATCTCGAGCGGAGGCTACTATTGGTCGTGGATTCGGCAGCACCCTGGAAAGGGCCTGGAATGGATCGGCTACATCTACTACTCCGGCTCGACCTACTACAACCCATCGCTGAAGTCCAGAGTGACAATCTCAGTGGACACGTCCAAGAATCAGTTCAGCCTGAAGCTCTCTTCCGTGACTGCGGCCGACACCGCCGTGTACTACTGCGCACGCGCTGGAATTGCCGCCCGGCTGAGGGGTGCCTTCGACATTTGGGGACAGGGCACCATGGTCACCGTGTCCTCCGGCGGCGGAGGTTCCGGGGGTGGAGGCTCAGGAGGAGGGGGGTCCGACATCGTCATGACTCAGTCGCCCTCAAGCGTCAGCGCGTCCGTCGGGGACAGAGTGATCATCACCTGTCGGGCGTCCCAGGGAATTCGCAACTGGCTGGCCTGGTATCAGCAGAAGCCCGGAAAGGCCCCCAACCTGTTGATCTACGCCGCCTCAAACCTCCAATCCGGGGTGCCGAGCCGCTTCAGCGGCTCCGGTTCGGGTGCCGATTTCACTCTGACCATCTCCTCCCTGCAACCTGAAGATGTGGCTACCTACTACTGCCAAAAGTACAACTCCGCACCTTTTACTTTCGGACCGGGGACCAAAGTGGACATTAAGACCACTACCCCAGCACCGAGGCCACCCACCCCGGCTCCTACCATCGCCTCCCAGCCTCTGTCCCTGCGTCCGGAGGCATGTAGACCCGCAGCTGGTGGGCCGTGCATACCCGGGGTCTTGACTTCGCCTGCGATATCTACATTTGGGCCCCTCTGGCTGGTACTTGCGGGGTCCTGCTGCTTTCACTCGTGATCACTCTTTACTGTAAGCGCGGTCGGAAGAAGCTGCTGTACATCTTTAAGCAACCCTTCATGAGGCCTGTGCAGACTACTCAAGAGGAGGACGGCTGTTCATGCCGGTTCCCAGAGGAGGAGGAAGGCGGCTGCGAACTGCGCGTGAAATTCAGCCGCAGCGCAGATGCTCCAGCCTACAAGCAGGGGCAGAACCAGCTCTACAACGAACTCAATCTTGGTCGGAGAGGAGTACGACGTGCTGGACAAGCGGAGAGGACGGGACCCAGAAATGGGCGGGAAGCCGCGCAGAAAGAATCCCCAAGAGGGCCTGTACAACGAGCTCCAAAAGGATAAGATGGCAGAAGCCTATAGCGAGATTGGTATGAAAGGGGAACGCAGAAGAGGCAAAGGCCACGACGGACTGTACCAGGGACTCAGCACCGCCACCAAGGACACCTATGACGCTCTTCACATGCAGGCCCTGCCGCCTCGG |
| | | 149368 |
| 149368-aa ScFv domain | 266 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL |
| 149368-nt ScFv domain | 267 | CAAGTGCAGCTGGTCCAGTCGGGCGCCGAGGTCAAGAAGCCCGGGAGCTCTGTGAAAGTGTCCTGCAAGGCCTCCGGGGCACCTTTAGCTCCTACGCCATCTCCTGGGTCCGCCAAGCACCGGGTCAAGGCCTGGAGTGGATGGGGGGAATTATCCCTATCTTCGGCACTGCCAACTACGCCCAGAAGTTCCAGGGACGCGTGACCATTACCGCGGACGAATCCACCTCCACCGCTTATATGGAGCTGTCCAGCTTGCGCTCGGAAGATACCGCCGTGTACTACTGCGCCCGGAGGGGTGGATACCAGCTGCTTAGATGGGACGTGGGCCTCCTGCGGTCGGCGTTCGACATCTGGGGCCAGGGCACTATGGTCACTGTGTCCAGCGGAGGAGGCGGATCGGGAGGCGGCGGATCAGGGGGAGGCGGTTCCAGCTACGTGCTTACTCAACCCCCTTCGGTGTCCGTGGCCCCGGGACAGACCGCCAGAATCACTTGCGGAGGAAACAACATTGGGTCCAAGAGCGTGCATTGGTACCAGCAGAAGCCAGGACAGGCCCCTGTGCTGGTGCTCTACGGGAAGAACAATCGGCCCAGCGGAGTGCCGGACAGGTTCTCGGGTTCACGCTCCGGTACAACCGCTTCACTGACTATCACCGGGGCCCAGGCAGAGGATGAAGCGGACTACTACTGTTCCTCCCGGGATTCATCCGGCGACCACCTCCGGGTGTTCGGAACCGGAACGAAGGTCACCGTGCTG |
| 149368-aa VH | 268 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS |
| 149368-aa VL | 269 | SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL |
| 149368-aa Full CAR | 270 | MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCE |

TABLE 11-continued

Amino Acid and Nucleic Acid Sequences of the anti-BCMA scFv domains and anti-BCMA CAR molecules

| Name/ Description | SEQ ID NO: | Sequence |
|---|---|---|
| | | LRVKFSRSADAPAYKQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 149368-nt Full CAR | 271 | ATGGCCCTCCCTGTCACCGCCCTGCTGCTTCCGCTGGCTCTTCTGCTCCACGCCGCTCGGCCCC AAGTGCAGCTGGTCCAGTCGGGCGCCGAGGTCAAGAAGCCCGGGAGCTCTGTGAAAGTGTCCTG CAAGGCCTCCGGGGGCACCTTTAGCTCCTACGCCATCTCCTGGGTCCGCCAAGCACCGGGTCAA GGCCTGGAGTGGATGGGGGGAATTATCCCTATCTTCGGCACTGCCAACTACGCCCAGAAGTTCC AGGGACGCGTGACCATTACCGCGGACGAATCCACCTCCACCGCTTATATGGAGCTGTCCAGCTT GCGCTCGGAAGATACCGCCGTGTACTACTGCGCCCGGAGGGGTGGATACCAGCTGCTGAGATGG GACGTGGGCCTCCTGCGGTCGGCGTTCGACATCTGGGGCCAGGGCACTATGGTCACTGTGTCCA GCGGAGGAGGCGGATCGGGAGGCGGCGGATCAGGGGGAGGCGGTTCCAGCTACGTGCTTACTCA ACCCCCTTCGGTGTCCGTGGCCCCGGGACAGACCGCCAGAATCACTTGCGGAGGAAACAACATT GGGTCCAAGAGCGTGCATTGGTACCAGCAGAAGCCAGGACAGGCCCCTGTGCTGGTGCTCTACG GAAGAACAATCGGCCAGCGGAGTGCCGGACAGGTTCTCGGGTTCACGCTCCGGTACAACCGC TTCACTGACTATCACCGGGGCCCAGGCAGAGGATGAAGCGGACTACTACTGTTCCTCCCGGGAT TCATCCGGCGACCACCTCCGGGTGTTCGGAACCGGAACGAAGGTCACCGTGCTGACCACTACCC CAGCACCGAGGCCACCCACCCCGGCTCCTACCATCGCCTCCCAGCCTCTGTCCCTGCGCTCCGGA GGCATGGTAGACCCGCAGCTGGTGGGGCCGTGCATACCCGGGGTCTTGACTTCGCCTGCGATATC TACATTTGGGCCCCTCTGGCTGGTACTTGCGGGGTCCTGCTGCTTTCACTCGTGATCACTCTTT ACTGTAAGCGCGGTCGGAAGAAGCTGCTGTACATCTTTAAGCAACCCTTCATGAGGCCTGTGCA GACTACTCAAGAGGAGGACGGCTGTTCATGCCGGTTCCCAGAGGAGGAGGAAGGCGGCTGCGAA CTGCGCGTGAAATTCAGCCGCAGCGCAGATGCTCCAGCCTACAAGCAGGGGCAGAACCAGCTCT ACAACGAACTCAATCTTGGTCGGAGAGAGGAGTACGACGTGCTGGACAAGCGGAGAGGACGGGA CCCAGAAATGGGCGGGAAGCCGCGCAGAAAGAATCCCAAGAGGGCCTGTACAACGAGCTCCAA AAGGATAAGATGGCAGAAGCCTATAGCGAGATTGGTATGAAAGGGGAACGCAGAAGAGGCAAAG GCCACGACGGACTGTACCAGGGACTCAGCACCGCCACCAAGGACACCTATGACGCTCTTCACAT GCAGGCCCTGCCGCCTCGG |
| | | 149369 |
| 149369-aa ScFv domain | 272 | EVQLQQSGPGLVKPSQTLSLTCAISGDSVSSNSAAWNWIRQSPSRGLEWLGRTYYRSKWYSFYA ISLKSRIIINPDTSKNQFSLQLKSVTPEDTAVYYCARSSPEGLFLYWFDPWGQGTLVTVSSGGD GSGGGGSGGGGSSSELTQDPAVSVALGQTIRITCQGDSLGNYYATWYQQKPGQAPVLVIYGTNN RPSGIPDRFSASSSGNTASLTITGAQAEDEADYYCNSRDSSGHHLLFGTGTKVTVL |
| 149369-nt ScFv domain | 273 | GAAGTGCAGCTCCAACAGTCAGGACCGGGGCTCGTGAAGCCATCCCAGACCCTGTCCCTGACTT GTGCCATCTCGGGAGATAGCGTGTCATCGAACTCCGCCGCCTGGAACTGGATTCGGCAGAGCCC GTCCCGCGGACTGGAGTGGCTTGGAAGGACCTACTACCGGTCCAAGTGGTACTCTTTCTACGCG ATCTCGCTGAAGTCCCGCATTATCATTAACCCTGATACCTCCAAGAATCAGTTCTCCCTCCAAC TGAAATCCGTCACCCCCGAGGACACAGCAGTGTATTACTGCGCACGGAGCAGCCCCGAAGGACT GTTCCTGTATTGGTTTGACCCCTGGGGCCAGGGGACTCTTGTGACCGTGTCGAGCGGCGGAGAT GGGTCCGGTGGCGGTGGTTCGGGGGGCGGCGGATCATCATCCGAACTGACCCAGGACCCGGCTG TGTCCGTGGCGCTGGGACAAACCATCCGCATTACGTGCCAGGGAGACTCCCTGGGCAACTACTA CGCCACTTGGTACCAGCAGAAGCCGGGCCAAGCCCCTGTGTTGGTCATCTACGGGACCAACAAC AGACCTTCCGGCATCCCCGACCGGTTCAGCGCTTCGTCCTCCGGCAACACTGCCAGCCTGACCA TCACTGGAGCGCAGGCCGAAGATGAGGCCGACTACTACTGCAACAGCAGAGACTCCTCGGGTCA TCACCTCTTGTTCGGAACTGGAACCAAGGTCACCGTGCTG |
| 149369-aa VH | 274 | EVQLQQSGPGLVKPSQTLSLTCAISGDSVSSNSAAWNWIRQSPSRGLEWLGRTYYRSKWYSFYA ISLKSRIIINPDTSKNQFSLQLKSVTPEDTAVYYCARSSPEGLFLYWFDPWGQGTLVTVSS |
| 149369-aa VL | 275 | SSELTQDPAVSVALGQTIRITCQGDSLGNYYATWYQQKPGQAPVLVIYGTNNRPSGIPDRFSAS SSGNTASLTITGAQAEDEADYYCNSRDSSGHHLLFGTGTKVTVL |
| 149369-aa Full CAR | 276 | MALPVTALLLPLALLLHAARPEVQLQQSGPGLVKPSQTLSLTCAISGDSVSSNSAAWNWIRQSP SRGLEWLGRTYYRSKWYSFYAISLKSRIIINPDTSKNQFSLQLKSVTPEDTAVYYCARSSPEGL FLYWFDPWGQGTLVTVSSGGDGSGGGGSGGGGSSSELTQDPAVSVALGQTIRITCQGDSLGNYY ATWYQQKPGQAPVLVIYGTNNRPSGIPDRFSASSSGNTASLTITGAQAEDEADYYCNSRDSSGH HLLFGTGTKVTVLTTTPAPRPPTPAPTIASQPLSLRPEACRPAAGGAVHTRGLDFACDIYIWAP LAGTCGVLLLSLVITLYCKRGRKKLLYIFKQPFMRPVQTTQEEDGCSCRFPEEEEGGCELRVKF SRSADAPAYKQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |
| 149369-nt Full CAR | 277 | ATGGCCCTCCCTGTCACCGCCCTGCTGCTTCCGCTGGCTCTTCTGCTCCACGCCGCTCGGCCCG AAGTGCAGCTCCAACAGTCAGGACCGGGGCTCGTGAAGCCATCCCAGACCCTGTCCCTGACTTG TGCCATCTCGGGAGATAGCGTGTCATCGAACTCCGCCGCCTGGAACTGGATTCGGCAGAGCCCG TCCCGCGGACTGGAGTGGCTTGGAAGGACCTACTACCGGTCCAAGTGGTACTCTTTCTACGCGA TCTCGCTGAAGTCCCGCATTATCATTAACCCTGATACCTCCAAGAATCAGTTCTCCCTCCAACT GAAATCCGTCACCCCCGAGGACACAGCAGTGTATTACTGCGCACGGAGCAGCCCCGAAGGACTG TTCCTGTATTGGTTTGACCCCTGGGGCCAGGGGACTCTTGTGACCGTGTCGAGCGGCGGAGATG GGTCCGGTGGCGGTGGTTCGGGGGGCGGCGGATCATCATCCGAACTGACCCAGGACCCGGCTGT GTCCGTGGCGCTGGGACAAACCATCCGCATTACGTGCCAGGGAGACTCCCTGGGCAACTACTAC GCCACTTGGTACCAGCAGAAGCCGGGCCAAGCCCCTGTGTTGGTCATCTACGGGACCAACAACA |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | GACCTTCCGGCATCCCCGACCGGTTCAGCGCTTCGTCCTCCGGCAACACTGCCAGCCTGACCAT<br>CACTGGAGCGCAGGCCGAAGATGAGGCCGACTACTACTGCAACAGCAGAGACTCCTCGGGTCAT<br>CACCTCTTGTTCGGAACTGGAACCAAGGTCACCGTGCTGACCACTACCCCAGCACCGAGGCCAC<br>CCACCCCGGCTCCTACCATCGCCTCCCAGCCTCTGTCCCTGCGTCCGGAGGCATGTAGACCCGC<br>AGCTGGTGGGGCCGTGCATACCCGGGGTCTTGACTTCGCCTGCGATATCTACATTTGGGCCCCT<br>CTGGCTGGTACTTGCGGGGTCCTGCTGCTTTCACTCGTGATCACTCTTTACTGTAAGCGCGGTC<br>GGAAGAAGCTGCTGTACATCTTTAAGCAACCCTTCATGAGGCCTGTGCAGACTACTCAAGAGGA<br>GGACGGCTGTTCATGCCGGTTCCCAGAGGAGGAGGAAGGCGGCTGCGAACTGCGCGTGAAATTC<br>AGCCGCAGCGCAGATGCTCCAGCCTACAAGCAGGGGCAGAACCAGCTCTACAACGAACTCAATC<br>TTGGTCGGAGAGAGGAGTACGACGTGCTGGACAAGCGGAGGACGGGACCCAGAAATGGGCGG<br>GAAGCCGCGCAGAAAGAATCCCCAAGAGGGCCTGTACAACGAGCTCCAAAAGGATAAGATGGCA<br>GAAGCCTATAGCGAGATTGGTATGAAAGGGGAACGCAGAAGAGGCAAAGGCCACGACGGACTGT<br>ACCAGGGACTCAGCACCGCCACCAAGGACACCTATGACGCTCTTCACATGCAGGCCCTGCCGCC<br>TCGG |

BCMA_EBB-C1978-A4

| Name/<br>Description | SEQ<br>ID<br>NO: | Sequence |
|---|---|---|
| BCMA_EBB-<br>C1978-A4 -<br>aa<br>ScFv domain | 278 | EVQLVESGGGLVQPGGSLRLSCAASGFTFSSYAMSWVRQAPGKGLEWVSAISGSGGSTYYADSV<br>KGRFTISRDNSKNTLYLQMNSLRAEDTAVYYCAKVEGSGSLDYWGQGTLVTVSSGGGGSGGGGS<br>GGGGSEIVMTQSPGTLSLSPGERATLSCRASQSVSSAYLAWYQQKPGQPPRLLISGASTRATGI<br>PDRFGGSGSGTDFTLTISRLEPEDFAVYYCQHYGSSFNGSSLFTFGQGTRLEIK |
| BCMA_EBB-<br>C1978-A4 - nt<br>ScFv domain | 279 | GAAGTGCAGCTCGTGGAGTCAGGAGGCGGCCTGGTCCAGCCGGGAGGGTCCCTTAGACTGTCAT<br>GCGCCGCAAGCGGATTCACTTTCTCCTCCTATGCCATGAGCTGGGTCCGCCAAGCCCCCGGAAA<br>GGGACTGGAATGGGTGTCCGCCATCTCGGGGTCTGGAGGCTCAACTTACTACGCTGACTCCGTG<br>AAGGGACGGTTCACCATTAGCCGCGACAACTCCAAGAACACCCTCTACCTCCAAATGAACTCCC<br>TGCGGGCCGAGGATACCGCCGTCTACTACTGCGCCAAAGTGGAAGGTTCAGGATCGCTGGACTA<br>CTGGGGACAGGGTACTCTCGTGACCGTGTCATCGGGCGGAGGAGGTTCCGGCGGTGGCGGCTCC<br>GGCGGCGGAGGGTCGGAGATCGTGATGACCCAGAGCCCTGGTACTCTGAGCCTTTCGCCGGGAG<br>AAAGGGCCACCCTGTCCTGCCGCGCTTCCCAATCCGTGTCCTCCGCGTACTTGGCGTGGTACCA<br>GCAGAAGCCGGGACAGCCCCCTCGGCTGCTGATCAGCGGGGCCAGCACCCGGGCAACCGGAATC<br>CCAGACAGATTCGGGGGTTCCGGCAGCGGCACAGATTTCACCCTGACTATTTCGAGGTTGGAGC<br>CCGAGGACTTTGCGGTGTATTACTGTCAGCACTACGGGTCGTCCTTTAATGGCTCCAGCCTGTT<br>CACGTTCGGACAGGGGACCCGCCTGGAAATCAAG |
| BCMA_EBB-<br>C1978-A4 -<br>aa<br>VH | 280 | EVQLVESGGGLVQPGGSLRLSCAASGFTFSSYAMSWVRQAPGKGLEWVSAISGSGGSTYYADSV<br>KGRFTISRDNSKNTLYLQMNSLRAEDTAVYYCAKVEGSGSLDYWGQGTLVTVSS |
| BCMA_EBB-<br>C1978-A4 -<br>aa<br>VL | 281 | EIVMTQSPGTLSLSPGERATLSCRASQSVSSAYLAWYQQKPGQPPRLLISGASTRATGIPDRFG<br>GSGSGTDFTLTISRLEPEDFAVYYCQHYGSSFNGSSLFTFGQGTRLEIK |
| BCMA_EBB-<br>C1978-A4 -<br>aa<br>Full CART | 282 | MALPVTALLLPLALLLHAARPEVQLVESGGGLVQPGGSLRLSCAASGFTFSSYAMSWVRQAPGK<br>GLEWVSAISGSGGSTYYADSVKGRFTISRDNSKNTLYLQMNSLRAEDTAVYYCAKVEGSGSLDY<br>WGQGTLVTVSSGGGGSGGGGSGGGGSEIVMTQSPGTLSLSPGERATLSCRASQSVSSAYLAWYQ<br>QKPGQPPRLLISGASTRATGIPDRFGGSGSGTDFTLTISRLEPEDFAVYYCQHYGSSFNGSSLF<br>TFGQGTRLEIKTTTPAPRPPTPAPTIASQPLSLRPEACRPAAGGAVHTRGLDFACDIYIWAPLA<br>GTCGVLLLSLVITLYCKRGRKKLLYIFKQPFMRPVQTTQEEDGCSCRFPEEEEGGCELRVKFSR<br>SADAPAYKQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| BCMA_EBB-<br>C1978-A4 - nt<br>Full CART | 283 | ATGGCCCTCCCTGTCACCGCCCTGCTGCTTCCGCTGGCTCTTCTGCTCCACGCCGCTCGGCCCG<br>AAGTGCAGCTCGTGGAGTCAGGAGGCGGCCTGGTCCAGCCGGGAGGGTCCCTTAGACTGTCATG<br>CGCCGCAAGCGGATTCACTTTCTCCTCCTATGCCATGAGCTGGGTCCGCCAAGCCCCCGGAAAG<br>GGACTGGAATGGGTGTCCGCCATCTCGGGGTCTGGAGGCTCAACTTACTACGCTGACTCCGTGA<br>AGGGACGGTTCACCATTAGCCGCGACAACTCCAAGAACACCCTCTACCTCCAAATGAACTCCCT<br>GCGGGCCGAGGATACCGCCGTCTACTACTGCGCCAAAGTGGAAGGTTCAGGATCGCTGGACTAC<br>TGGGGACAGGGTACTCTCGTGACCGTGTCATCGGGCGGAGGAGGTTCCGGCGGTGGCGGCTCCG<br>GCGGCGGAGGGTCGGAGATCGTGATGACCCAGAGCCCTGGTACTCTGAGCCTTTCGCCGGGAGA<br>AAGGGCCACCCTGTCCTGCCGCGCTTCCCAATCCGTGTCCTCCGCGTACTTGGCGTGGTACCAG<br>CAGAAGCCGGGACAGCCCCCTCGGCTGCTGATCAGCGGGGCCAGCACCCGGGCAACCGGAATCC<br>CAGACAGATTCGGGGGTTCCGGCAGCGGCACAGATTTCACCCTGACTATTTCGAGGTTGGAGCC<br>CGAGGACTTTGCGGTGTATTACTGTCAGCACTACGGGTCGTCCTTTAATGGCTCCAGCCTGTTC<br>ACGTTCGGACAGGGGACCCGCCTGGAAATCAAGACCACTACCCCAGCACCGAGGCCACCCACCC<br>CGGCTCCTACCATCGCCTCCCAGCCTCTGTCCCTGCGTCCGGAGGCATGTAGACCCGCAGCTGG<br>TGGGGCCGTGCATACCCGGGGTCTTGACTTCGCCTGCGATATCTACATTTGGGCCCCTCTGGCT<br>GGTACTTGCGGGGTCCTGCTGCTTTCACTCGTGATCACTCTTTACTGTAAGCGCGGTCGGAAGA<br>AGCTGCTGTACATCTTTAAGCAACCCTTCATGAGGCCTGTGCAGACTACTCAAGAGGAGGACGG<br>CTGTTCATGCCGGTTCCCAGAGGAGGAGGAAGGCGGCTGCGAACTGCGCGTGAAATTCAGCCGC<br>AGCGCAGATGCTCCAGCCTACAAGCAGGGGCAGAACCAGCTCTACAACGAACTCAATCTTGGTC |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | GGAGAGAGGAGTACGACGTGCTGGACAAGCGGAGAGGACGGGACCCAGAAATGGGCGGGAAGCC<br>GCGCAGAAAGAATCCCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGACGGACTGTACCAGG<br>GACTCAGCACCGCCACCAAGGACACCTATGACGCTCTTCACATGCAGGCCCTGCCGCCTCGG |

BCMA_EBB-C1978-G1

| BCMA_EBB-<br>C1978-G1 -<br>aa<br>ScFv domain | 284 | EVQLVETGGGLVQPGGSLRLSCAASGITFSRYPMSWVRQAPGKGLEWVSGISDSGVSTY<br>YADSAKGRFTISRDNSKNTLFLQMSSLRDEDTAVYYCVTRAGSEASDIWGQGTMVTVS<br>SGGGGSGGGGSGGGGSEIVLTQSPATLSLSPGERATLSCRASQSVSNSLAWYQQKPGQA<br>PRLLIYDASSRATGIPDRFSGSGSGTDFTLTISRLEPEDFAIYYCQQFGTSSGLTFGGGTKL<br>EIK |
| BCMA_EBB-<br>C1978-G1 -<br>nt<br>ScFv domain | 285 | GAAGTGCAACTGGTGGAAACCGGTGGCGGCCTGGTGCAGCCTGGAGGATCATTGAGGCTGTCAT<br>GCGCGGCCAGCGGTATTACCTTCTCCCGGTACCCCATGTCCTGGGTCAGACAGGCCCCGGGGAA<br>AGGGCTTGAATGGGTGTCCGGGATCTCGGACTCCGGTGTCAGCACTTACTACGCCGACTCCGCC<br>AAGGGACGCTTCACCATTTCCCGGGACAACTCGAAGAACACCCTGTTCCTCCAAATGAGCTCCC<br>TCCGGGACGAGGATACTGCAGTGTACTACTGCGTGACCCGCGCCGGGTCCGAGGCGTCTGACAT<br>TTGGGGACAGGGCACTATGGTCACCGTGTCGTCCGGCGGAGGGGGCTCGGGAGGCGGTGGCAGC<br>GGAGGAGGAGGGTCCGAGATCGTGCTGACCCAATCCCCGGCCACCCTCTCGCTGAGCCCTGGAG<br>AAAGGGCAACCTTGTCCTGTCGCGCGAGCCAGTCCGTGAGCAACTCCCTGGCCTGGTACCAGCA<br>GAAGCCCGGACAGGCTCCGAGACTTCTGATCTACGACGCTTCGAGCCGGGCCACTGGAATCCCC<br>GACCGCTTTTCGGGGTCCGGCTCAGGAACCGATTTCACCCTGACAATCTCACGGCTGGAGCCAG<br>AGGATTTCGCCATCTATTACTGCCAGCAGTTCGGTACTTCCTCCGGCCTGACTTTCGGAGGCGG<br>CACGAAGCTCGAAATCAAG |
| BCMA_EBB-<br>C1978-G1 -<br>aa<br>VH | 286 | EVQLVETGGGLVQPGGSLRLSCAASGITFSRYPMSWVRQAPGKGLEWVSGISDSGVSTYYADSA<br>KGRFTISRDNSKNTLFLQMSSLRDEDTAVYYCVTRAGSEASDIWGQGTMVTVSS |
| BCMA_EBB-<br>C1978-G1 -<br>aa<br>VL | 287 | EIVLTQSPATLSLSPGERATLSCRASQSVSNSLAWYQQKPGQAPRLLIYDASSRATGIPDRFSG<br>SGSGTDFTLTISRLEPEDFAIYYCQQFGTSSGLTFGGGTKLEIK |
| BCMA_EBB-<br>C1978-G1 -<br>aa<br>Full CART | 288 | MALPVTALLLPLALLLHAARPEVQLVETGGGLVQPGGSLRLSCAASGITFSRYPMSWVR<br>QAPGKGLEWVSGISDSGVSTYYADSAKGRFTISRDNSKNTLFLQMSSLRDEDTAVYYCV<br>TRAGSEASDIWGQGTMVTVSSGGGGSGGGGSGGGGSEIVLTQSPATLSLSPGERATLSC<br>RASQSVSNSLAWYQQKPGQAPRLLIYDASSRATGIPDRFSGSGSGTDFTLTISRLEPEDFA<br>IYYCQQFGTSSGLTFGGGTKLEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCREPEEEEGGCELRVKFSRSADAPAYKQGQNQLYNELNLGRREEYDVLDKRRGRDPE<br>MGGKPRRKNPQEGLYNELQKDKMAEAYSEIGMKGERRRGKGHDGLYQGLSTATKDT<br>YDALHMQALPPR |
| BCMA_EBB-<br>C1978-G1 -<br>nt<br>Full CART | 289 | ATGGCCCTCCCTGTCACCGCCCTGCTGCTTCCGCTGGCTCTTCTGCTCCACGCCGCTCGGCCCG<br>AAGTGCAACTGGTGGAAACCGGTGGCGGCCTGGTGCAGCCTGGAGGATCATTGAGGCTGTCATG<br>CGCGGCCAGCGGTATTACCTTCTCCCGGTACCCCATGTCCTGGGTCAGACAGGCCCCGGGGAAA<br>GGGCTTGAATGGGTGTCCGGGATCTCGGACTCCGGTGTCAGCACTTACTACGCCGACTCCGCCA<br>AGGGACGCTTCACCATTTCCCGGGACAACTCGAAGAACACCCTGTTCCTCCAAATGAGCTCCCT<br>CCGGGACGAGGATACTGCAGTGTACTACTGCGTGACCCGCGCCGGGTCCGAGGCGTCTGACATT<br>TGGGGACAGGGCACTATGGTCACCGTGTCGTCCGGCGGAGGGGGCTCGGGAGGCGGTGGCAGCG<br>GAGGAGGAGGGTCCGAGATCGTGCTGACCCAATCCCCGGCCACCCTCTCGCTGAGCCCTGGAGA<br>AAGGGCAACCTTGTCCTGTCGCGCGAGCCAGTCCGTGAGCAACTCCCTGGCCTGGTACCAGCAG<br>AAGCCCGGACAGGCTCCGAGACTTCTGATCTACGACGCTTCGAGCCGGGCCACTGGAATCCCCG<br>ACCGCTTTTCGGGGTCCGGCTCAGGAACCGATTTCACCCTGACAATCTCACGGCTGGAGCCAGA<br>GGATTTCGCCATCTATTACTGCCAGCAGTTCGGTACTTCCTCCGGCCTGACTTTCGGAGGCGGC<br>ACGAAGCTCGAAATCAAGACCACTACCCCAGCACCGAGGCCACCCACCCCGGCTCCTACCATCG<br>CCTCCCAGCCTCTGTCCCTGCGTCCGGAGGCATGTAGACCCGCAGCTGGTGGGGCCGTGCATAC<br>CCGGGGTCTTGACTTCGCCTGCGATATCTACATTTGGGCCCCTCTGGCTGGACTTGCGGGGTC<br>CTGCTGCTTTCACTCGTGATCACTCTTTACTGTAAGCGCGGTCGGAAGAAGCTGCTGTACATCT<br>TTAAGCAACCCTTCATGAGGCCTGTGCAGACTACTCAAGAGGAGGACGGCTGTTCATGCCGGTT<br>CCCAGAGGAGGAGGAAGGCGGCTGCGAACTGCGCGTGAAATTCAGCCGCAGCGCAGATGCTCCA<br>GCCTACAAGCAGGGGCAGAACCAGCTCTACAACGAACTCAATCTTGGTCGGAGAGAGGAGTACG<br>ACGTGCTGGACAAGCGGAGAGGACGGGACCCAGAAATGGGCGGGAAGCCGCGCAGAAAGAATCC<br>CCAAGAGGGCCTGTACAACGAGCTCCAAAAGGATAAGATGGCAGAAGCCTATAGCGAGATTGGT<br>ATGAAAGGGGAACGCAGAAGAGGCAAAGGCCACGACGGACTGTACCAGGGACTCAGCACCGCCA<br>CCAAGGACACCTATGACGCTCTTCACATGCAGGCCCTGCCGCCTCGG |

TABLE 11-continued

Amino Acid and Nucleic Acid Sequences of the anti-BCMA scFv domains and anti-BCMA CAR molecules

| Name/ Description | SEQ ID NO: | Sequence |
|---|---|---|
| | | BCMA_EBB-C1979-C1 |
| BCMA_EBB-C1979-C1 - aa ScFv domain | 290 | QVQLVESGGGLVQPGGSLRLSCAASGFTFSSYAMSWVRQAPGKGLEWVSAISGSGGSTYYADSV KGRFTISRDNAKNSLYLQMNSLRAEDTAIYYCARATYKRELRYYYGMDVWGQGTMVTVSSGGGG SGGGGSGGGGSEIVMTQSPGTVSLSPGERATLSCRASQSVSSSFLAWYQQKPGQAPRLLIYGAS SRATGIPDRFSGSGSGTDFTLTISRLEPEDSAVYYCQQYHSSPSWTFGQGTRLEIK |
| BCMA_EBB-C1979-C1 - nt ScFv domain | 291 | CAAGTGCAGCTCGTGGAATCGGGTGGCGGACTGGTGCAGCCGGGGGGCTCACTTAGACTGTCCT GCGCGGCCAGCGGATTCACTTTCTCCTCCTACGCCATGTCCTGGGTCAGACAGGCCCCTGGAAA GGGCCTGGAATGGGTGTCCGCAATCAGCGGCAGCGGCGGCTCGACCTATTACGCGGATTCAGTG AAGGGCAGATTCACCATTTCCCGGGACAACGCCAAGAACTCCTTGTACCTTCAAATGAACTCCC TCCGCGCGGAAGATACCGCAATCTACTACTGCGCTCGGGCCACTTACAAGAGGGAACTGCGCTA CTACTACGGGATGGACGTCTGGGGCCAGGGAACCATGGTCACCGTGTCCAGCGGAGGAGGAGGA TCGGGAGGAGGCGGTAGCGGGGGTGGAGGGTCGGAGATCGTGATGACCCAGTCCCCCGGCACTG TGTCGCTGTCCCCCGGCGAACGGGCCACCCTGTCATGTCGGGCCAGCCAGTCAGTGTCGTCAAG CTTCCTCGCCTGGTACCAGCAGAAACCGGGACAAGCTCCCCGCCTGCTGATCTACGGAGCCAGC AGCCGGGCCACCGGTATTCCTGACCGGTTCTCCGGTTCGGGGTCCGGGACCGACTTTACTCTGA CTATCTCTCGCCTCGAGCCAGAGGACTCCGCCGTGTATTACTGCCAGCAGTACCACTCCTCCCC GTCCTGGACGTTCGGACAGGGCACAAGGCTGGAGATTAAG |
| BCMA_EBB-C1979-C1 - aa VH | 292 | QVQLVESGGGLVQPGGSLRLSCAASGFTFSSYAMSWVRQAPGKGLEWVSAISGSGGSTYYADSV KGRFTISRDNAKNSLYLQMNSLRAEDTAIYYCARATYKRELRYYYGMDVWGQGTMVTVSS |
| BCMA_EBB-C1979-C1 - aa VL | 293 | EIVMTQSPGTVSLSPGERATLSCRASQSVSSSFLAWYQQKPGQAPRLLIYGASSRATGIPDRFS GSGSGTDFTLTISRLEPEDSAVYYCQQYHSSPSWTFGQGTRLEIK |
| BCMA_EBB-C1979-C1 - aa Full CART | 294 | MALPVTALLLPLALLLHAARPQVQLVESGGGLVQPGGSLRLSCAASGFTFSSYAMSWVRQAPGK GLEWVSAISGSGGSTYYADSVKGRFTISRDNAKNSLYLQMNSLRAEDTAIYYCARATYKRELRY YYGMDVWGQGTMVTVSSGGGGSGGGGSGGGGSEIVMTQSPGTVSLSPGERATLSCRASQSVSSS FLAWYQQKPGQAPRLLIYGASSRATGIPDRFSGSGSGTDFTLTISRLEPEDSAVYYCQQYHSSP SWTFGQGTRLEIKTTTPAPRPPTPAPTIASQPLSLRPEACRPAAGGAVHTRGLDFACDIYIWAP LAGTCGVLLLSLVITLYCKRGRKKLLYIFKQPFMRPVQTTQEEDGCSCRFPEEEEGGCELRVKF SRSADAPAYKQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |
| BCMA_EBB-C1979-C1 - nt Full CART | 295 | ATGGCCCTCCCTGTCACCGCCCTGCTGCTTCCGCTGGCTCTTCTGCTCCACGCGCTCGGCCCC AAGTGCAGCTCGTGGAATCGGGTGGCGGACTGGTGCAGCCGGGGGGCTCACTTAGACTGTCCTG CGCGGCCAGCGGATTCACTTTCTCCTCCTACGCCATGTCCTGGGTCAGACAGGCCCCTGGAAAG GGCCTGGAATGGGTGTCCGCAATCAGCGGCAGCGGCGGCTCGACCTATTACGCGGATTCAGTGA AGGGCAGATTCACCATTTCCCGGGACAACGCCAAGAACTCCTTGTACCTTCAAATGAACTCCCT CCGCGCGGAAGATACCGCAATCTACTACTGCGCTCGGGCCACTTACAAGAGGGAACTGCGCTAC TACTACGGGATGGACGTCTGGGGCCAGGGAACCATGGTCACCGTGTCCAGCGGAGGAGGAGGAT CGGGAGGAGGCGGTAGCGGGGGTGGAGGGTCGGAGATCGTGATGACCCAGTCCCCCGGCACTGT GTCGCTGTCCCCCGGCGAACGGGCCACCCTGTCATGTCGGGCCAGCCAGTCAGTGTCGTCAAGC TTCCTCGCCTGGTACCAGCAGAAACCGGGACAAGCTCCCCGCCTGCTGATCTACGGAGCCAGCA GCCGGGCCACCGGTATTCCTGACCGGTTCTCCGGTTCGGGGTCCGGGACCGACTTTACTCTGAC TATCTCTCGCCTCGAGCCAGAGGACTCCGCCGTGTATTACTGCCAGCAGTACCACTCCTCCCCG TCCTGGACGTTCGGACAGGGCACAAGGCTGGAGATTAAGACCACTACCCCAGCACCGAGGCCAC CCACCCCGGCTCCTACCATCGCCTCCCAGCCTCTGTCCCTGCGCTCCGGAGGCATGTAGACCCGC AGCTGGTGGGGCCGTGCATACCCGGGGTCTTGACTTCGCCTGCGATATCTACATTTGGGCCCCT CTGGCTGGTACTTGCGGGGTCCTGCTGCTTTCACTCGTGATCACTCTTTACTGTAAGCGCGGTC GGAAGAAGCTGCTGTACATCTTTAAGCAACCCTTCATGAGGCCTGTGCAGACTACTCAAGAGGA GGACGGCTGTTCATGCCGGTTCCCAGAGGAGGAGGAAGGCGGCTGCGAACTGCGCGTGAAATTC AGCCGCAGCGCAGATGCTCCAGCCTACAAGCAGGGGCAGAACCAGCTCTACAACGAACTCAATC TTGGTCGGAGAGAGGAGTACGACGTGCTGGACAAGCGGAGAGGACGGGACCCAGAAATGGGCGG GAAGCCGCGCAGAAAGAATCCCCAAGAGGGCCTGTACAACGAGCTCCAAAAGGATAAGATGGCA GAAGCCTATAGCGAGATTGGTATGAAAGGGGAACGCAGAAGAGGCAAAGGCCACGACGGACTGT ACCAGGGACTCAGCACCGCCACCAAGGACACCTATGACGCTCTTCACATGCAGGCCCTGCCGCC TCGG |
| | | BCMA_EBB-C1978-C7 |
| BCMA_EBB-C1978-C7 - aa ScFv domain | 296 | EVQLVETGGGLVQPGGSLRLSCAASGFTFSSYAMSWVRQAPGKGLEWVSAISGSGGSTYYADSV KGRFTISRDNSKNTLYLQMNTLKEDTAVYYCARATYKRELRYYYGMDVWGQGTTVTVSSGGGGS GGGGSGGGGSEIVLTQSPSTLSLSPGESATLSCRASQSVSTTFLAWYQQKPGQAPRLLIYGSS NRATGIPDRFSGSGSGTDFTLTIRRLEPEDFAVYYCQQYHSSPSWTFGQGTKVEIK |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| BCMA_EBB-<br>C1978-C7 - nt<br>ScFv domain | 297 | GAGGTGCAGCTTGTGGAAACCGGTGGCGGACTGGTGCAGCCCGGAGGAAGCCTCAGGCTGTCCT<br>GCGCCGCGTCCGGCTTCACCTTCTCCTCGTACGCCATGTCCTGGGTCCGCCAGGCCCCCGGAAA<br>GGGCCTGGAATGGGTGTCCGCCATCTCTGGAAGCGGAGGTTCCACGTACTACGCGGACAGCGTC<br>AAGGGAAGGTTCACAATCTCCCGCGATAATTCGAAGAACACTCTGTACCTTCAAATGAACACCC<br>TGAAGGCCGAGGACACTGCTGTGTACTACTGCGCACGGGCCACCTACAAGAGAGAGCTCCGGTA<br>CTACTACGGAATGGACGTCTGGGGCCAGGGAACTACTGTGACCGTGTCCTCGGGAGGGGGTGGC<br>TCCGGGGGGGGCGGCTCCGGCGGAGGCGGTTCCGAGATTGTGCTGACCCAGTCACCTTCAACTC<br>TGTCGCTGTCCCCGGGAGAGAGCGCTACTCTGAGCTGCCGGGCCAGCCAGTCCGTGTCCACCAC<br>CTTCCTCGCCTGGTATCAGCAGAAGCCGGGGCAGGCACCACGGCTCTTGATCTACGGGTCAAGC<br>AACAGAGCGACCGGAATTCCTGACCGCTTCTCGGGGAGCGGTTCAGGCACCGACTTCACCCTGA<br>CTATCCGGCGCCTGGAACCCGAAGATTTCGCCGTGTATTACTGTCAACAGTACCACTCCTCGCC<br>GTCCTGGACCTTTGGCCAAGGAACCAAAGTGGAAATCAAG |
| BCMA_EBB-<br>C1978-C7 -<br>aa<br>VH | 298 | EVQLVETGGGLVQPGGSLRLSCAASGFTFSSYAMSWVRQAPGKGLEWVSAISGSGGSTYYADSV<br>KGRFTISRDNSKNTLYLQMNTLKAEDTAVYYCARATYKRELRYYYGMDVWGQGTTVTVSS |
| BCMA_EBB-<br>C1978-C7 -<br>aa<br>VL | 299 | EIVLTQSPSTLSLSPGESATLSCRASQSVSTTFLAWYQQKPGQAPRLLIYGSSNRATGIPDRFS<br>GSGSGTDFTLTIRRLEPEDFAVYYCQQYHSSPSWTFGQGTKVEIK |
| BCMA_EBB-<br>C1978-C7 -<br>aa<br>Full CART | 300 | MALPVTALLLPLALLLHAARPEVQLVETGGGLVQPGGSLRLSCAASGFTFSSYAMSWVRQAPGK<br>GLEWVSAISGSGGSTYYADSVKGRFTISRDNSKNTLYLQMNTLKAEDTAVYYCARATYKRELRY<br>YYGMDVWGQGTTVTVSSGGGGSGGGGSGGGGSEIVLTQSPSTLSLSPGESATLSCRASQSVSTT<br>FLAWYQQKPGQAPRLLIYGSSNRATGIPDRFSGSGSGTDFTLTIRRLEPEDFAVYYCQQYHSSP<br>SWTFGQGTKVEIKTTTPAPRPPTPAPTIASQPLSLRPEACRPAAGGAVHTRGLDFACDIYIWAP<br>LAGTCGVLLLSLVITLYCKRGRKKLLYIFKQPFMRPVQTTQEEDGCSCRFPEEEEGGCELRVKF<br>SRSADAPAYKQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| BCMA_EBB-<br>C1978-C7 - nt<br>Full CART | 301 | ATGGCCCTCCCTGTCACCGCCCTGCTGCTTCCGCTGGCTCTTCTGCTCCACGCCGCTCGGCCCG<br>AGGTGCAGCTTGTGGAAACCGGTGGCGGACTGGTGCAGCCCGGAGGAAGCCTCAGGCTGTCCTG<br>CGCCGCGTCCGGCTTCACCTTCTCCTCGTACGCCATGTCCTGGGTCCGCCAGGCCCCCGGAAAG<br>GGCCTGGAATGGGTGTCCGCCATCTCTGGAAGCGGAGGTTCCACGTACTACGCGGACAGCGTCA<br>AGGGAAGGTTCACAATCTCCCGCGATAATTCGAAGAACACTCTGTACCTTCAAATGAACACCCT<br>GAAGGCCGAGGACACTGCTGTGTACTACTGCGCACGGGCCACCTACAAGAGAGAGCTCCGGTAC<br>TACTACGGAATGGACGTCTGGGGCCAGGGAACTACTGTGACCGTGTCCTCGGGAGGGGGTGGCT<br>CCGGGGGGGGCGGCTCCGGCGGAGGCGGTTCCGAGATTGTGCTGACCCAGTCACCTTCAACTCT<br>GTCGCTGTCCCCGGGAGAGAGCGCTACTCTGAGCTGCCGGGCCAGCCAGTCCGTGTCCACCACC<br>TTCCTCGCCTGGTATCAGCAGAAGCCGGGGCAGGCACCACGGCTCTTGATCTACGGGTCAAGCA<br>ACAGAGCGACCGGAATTCCTGACCGCTTCTCGGGGAGCGGTTCAGGCACCGACTTCACCCTGAC<br>TATCCGGCGCCTGGAACCCGAAGATTTCGCCGTGTATTACTGTCAACAGTACCACTCCTCGCCG<br>TCCTGGACCTTTGGCCAAGGAACCAAAGTGGAAATCAAGACCACTACCCCAGCACCGAGGCCAC<br>CCACCCCGGCTCCTACCATCGCCTCCCAGCCTCTGTCCCTGCGTCCGGAGGCATGTAGACCCGC<br>AGCTGGTGGGGCCGTGCATACCCGGGGTCTTGACTTCGCCTGCGATATCTACATTTGGGCCCCT<br>CTGGCCTGGTACTTGCGGGGTCCTGCTGCTTTCACTCGTGATCACTCTTTACTGTAAGCGCGGTC<br>GGAAGAAGCTGCTGTACATCTTTAAGCAACCCTTCATGAGGCCTGTGCAGACTACTCAAGAGGA<br>GGACGGCTGTTCATGCCGGTTCCCAGAGGAGGAGGAAGGCGGCTGCGAACTGCGCGTGAAATTC<br>AGCCGCAGCGCAGATGCTCCAGCCTACAAGCAGGGGCAGAACCAGCTCTACAACGAACTCAATC<br>TTGGTCGGAGAGAGGAGTACGACGTGCTGGACAAGCGGAGAGGACGGGACCCAGAAATGGGCGG<br>GAAGCCGCGCAGAAAGAATCCCCAAGGAGGGCCTGTACAACGAGCTCCAAAAGGATAAGATGGCA<br>GAAGCCTATAGCGAGATTGGTATGAAAGGGGAACGCAGAAGAGGCAAAGGCCACGACGGACTGT<br>ACCAGGGACTCAGCACCGCCACCAAGGACACCTATGACGCTCTTCACATGCAGGCCCTGCCGCC<br>TCGG |
| BCMA_EBB-C1978-D10 | | |
| BCMA_EBB-<br>C1978-D10 -<br>aa<br>ScFv domain | 302 | EVQLVETGGGLVQPGRSLRLSCAASGFTFDDYAMHWVRQAPGKGLEWVSGISWNSGSIGYADSV<br>KGRFTISRDNAKNSLYLQMNSLRDEDTAVYYCARVGKAVPDVWGQGTTVTVSSGGGGSGGGGSG<br>GGGSDIVMTQTPSSLSASVGDRVTITCRASQSISSYLNWYQQKPGKAPKLLIYAASSLQSGVPS<br>RFSGSGSGTDFTLTISSLQPEDFATYYCQQSYSTPYSFGQGTRLEIK |
| BCMA_EBB-<br>C1978-D10-<br>nt<br>ScFv domain | 303 | GAAGTGCAGCTCGTGGAAACTGGAGGTGGACTCGTGCAGCCTGGACGGTCGCTGCGGCTGAGCT<br>GCGCTGCATCCGGCTTCACCTTCGACGATTATGCCATGCACTGGGTCAGACAGGCGCCAGGGAA<br>GGGACTTGAGTGGGTGTCCGGTATCAGCTGGAATAGCGGCTCAATCGGATACGCGGACTCCGTG<br>AAGGGAAGGTTCACCATTTCCCGCGACAACGCCAAGAACTCCCTGTACTTGCAAATGAACAGCC<br>TCCGGGATGAGGACACTGCCGTGTACTACTGCGCCCGCGTCGGAAAAGCTGTGCCCGACGTCTG<br>GGGCCAGGGAACCACTGTGACCGTGTCCAGCGGCGGGGTGGATCGGCGGTGAGGGTCCGGT<br>GGAGGGGGCTCAGATATTGTGATGACCCAGACCCCCTCGTCCCTGTCCGCCTCGGTCGGCGACC<br>GCGTGACTATCACATGTAGAGCCTCGCAGAGCATCTCCAGCTACCTGAACTGGTATCAGCAGAA<br>GCCGGGGAAGGCCCCCGAAGCTCCTGATCTACGCGGCATCATCACTGCAATCGGGAGTGCCGAGC TABLE 11-continued Amino Acid and Nucleic Acid Sequences of the anti-BCMA scFv domains and anti-BCMA CAR molecules

| Name/Description | SEQ ID NO: | Sequence |
|---|---|---|
| | | CGGTTTTCCGGGTCCGGCTCCGGCACCGACTTCACGCTGACCATTTCTTCCCTGCAACCCGAGG<br>ACTTCGCCACTTACTACTGCCAGCAGTCCTACTCCACCCCTTACTCCTTCGGCCAAGGAACCAG<br>GCTGGAAATCAAG |
| BCMA_EBB-C1978-D10 -aa VH | 304 | EVQLVETGGGLVQPGRSLRLSCAASGFTFDDYAMHWVRQAPGKGLEWVSGISWNSGSIGYADSV<br>KGRFTISRDNAKNSLYLQMNSLRDEDTAVYYCARVGKAVPDVWGQGTTVTVSS |
| BCMA_EBB-C1978-D10-aa VL | 305 | DIVMTQTPSSLSASVGDRVTITCRASQSISSYLNWYQQKPGKAPKLLIYAASSLQSGVPSRFSG<br>SGSGTDFTLTISSLQPEDFATYYCQQSYSTPYSFGQGTRLEIK |
| BCMA_EBB-C1978-D10 -aa Full CART | 306 | MALPVTALLLPLALLLHAARPEVQLVETGGGLVQPGRSLRLSCAASGFTFDDYAMHWVRQAPGK<br>GLEWVSGISWNSGSIGYADSVKGRFTISRDNAKNSLYLQMNSLRDEDTAVYYCARVGKAVPDVW<br>GQGTTVTVSSGGGGSGGGGSGGGGSDIVMTQTPSSLSASVGDRVTITCRASQSISSYLNWYQQK<br>PGKAPKLLIYAASSLQSGVPSRFSGSGSGTDFTLTISSLQPEDFATYYCQQSYSTPYSFGQGTR<br>LEIKTTTPAPRPPTPAPTIASQPLSLRPEACRPAAGGAVHTRGLDFACDIYIWAPLAGTCGVLL<br>LSLVITLYCKRGRKKLLYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNELQKDKMAEAYSEIGMK<br>GERRRGKGHDGLYQGLSTATKDTYDALHMQALPPR |
| BCMA_EBB-C1978-D10 -nt Full CART | 307 | ATGGCCCTCCCTGTCACCGCCCTGCTGCTTCCGCTGGCTCTTCTGCTCCACGCGCTCGGCCCG<br>AAGTGCAGCTCGTGGAAACTGGAGGTGGACTCGTGCAGCCTGGACGGTCGCTGCGCTGAGCTG<br>CGCTGCATCCGGCTTCACCTTCGACGATTATGCCATGCACTGGGTCAGACAGGCGCCAGGGAAG<br>GGACTTGAGTGGGTGTCCGGTATCAGCTGGAATAGCGGCTCAATCGGATACGCGGACTCCGTGA<br>AGGGGAAGGTTCACCATTTCCCGCGACAACGCCAAGAACTCCCTGTACTTGCAAATGAACAGCCT<br>CCGGGATGAGGACACTGCCGTGTACTACTGCGCCCGCGTCGGAAAAGCTGTGCCCGACGTCTGG<br>GGCCAGGGAACCACTGTGACCGTGTCCAGCGGCGGGGGTGGATCGGGCGGTGGAGGGTCCGGTG<br>GAGGGGGCTCAGATATTGTGATGACCCAGACCCCCTCGTCCCTGTCCGCCTCGGTCGGCGACCG<br>CGTGACTATCACATGTAGAGCCTCGCAGAGCATCTCCAGCTACCTGAACTGGTATCAGCAGAAG<br>CCGGGGAAGGCCCCGAAGCTCCTGATCTACGCGGCATCATCACTGCAATCGGGAGTGCCGAGCC<br>GGTTTTCCGGGTCCGGCTCCGGCACCGACTTCACGCTGACCATTTCTTCCCTGCAACCCGAGGA<br>CTTCGCCACTTACTACTGCCAGCAGTCCTACTCCACCCCTTACTCCTTCGGCCAAGGAACCAGG<br>CTGGAAATCAAGACCACTACCCCAGCACCGAGGCCACCCACCCCGGCTCCTACCATCGCCTCCC<br>AGCCTCTGTCCCTGCGTCGGAGGCATGTAGACCCGCAGCTGGTGGGGCCGTGCATACCCGGGG<br>TCTTGACTTCGCCTGCGATATCTACATTTGGGCCCCTCTGGCTGGTACTTGCGGGGTCCTGCTG<br>CTTTCACTCGTGATCACTCTTTTACTGTAAGCGCGGTCGGAAGAAGCTGCTGTACATCTTTAAGC<br>AACCCTTCATGAGGCCTGTGCAGACTACTCAAGAGGAGGACGGCTGTTCATGCCGGTTCCCAGA<br>GGAGGAGGAAGGCGGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAGGAGTACGACGTGC<br>TGGACAAGCGGAGAGGACGGGACCCAGAAATGGGCGGGAAGCCGCGCAGAAAGAATCCCCAAGA<br>GGGCCTGTACAACGAGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAGCACCGCCACCAAGG<br>ACACCTATGACGCTCTTCACATGCAGGCCCTGCCGCCTCGG |

BCMA_EBB-C1979-C12

| Name/Description | SEQ ID NO: | Sequence |
|---|---|---|
| BCMA EBB-C1979-C12-aa ScFv domain | 308 | EVQLVESGGGLVQPGRSLRLSCTASGFTFDDYAMHWVRQRPGKGLEWVASINWKGNSLAYGDSV<br>KGRFAISRDNAKNTVFLQMNSLRTEDTAVYYCASHQGVAYYNYAMDVWGRGTLVTVSSGGGGSG<br>GGGSGGGGSEIVLTQSPGTLSLSPGERATLSCRATQSIGSSFLAWYQQRPGQAPRLLIYGASQR<br>ATGIPDRFSGRGSGTDFTLTISRVEPEDSAVYYCQHYESSPSWTFGQGTKVEIK |
| BCMA_EBB-C1979-C12 -nt ScFv domain | 309 | GAAGTGCAGCTCGTGGAGAGCGGGGGAGGATTGGTGCAGCCCGGAAGGTCCCTGCGGCTCTCCT<br>GCACTGCGTCTGGCTTCACCTTCGACGACTACGCGATGCACTGGGTCAGACAGCGCCCGGGAAA<br>GGGCCTGGAATGGGTCGCCTCAATCAACTGGAAGGGAAATCCCTGGCCTATGGCGACAGCGTG<br>AAGGGCCGCTTCGCCATTTCGCGCGACAACGCCAAGAACACCGTGTTTCTGCAAATGAATTCCC<br>TGCGGACCGAGGATACCGCTGTGTACTACTGCGCCAGCCACCAGGGCGTGGCATACTATAACTA<br>CGCCATGGACGTGTGGGGAAGAGGGACGCTCGTCACCGTGTCCTCCGGGGGCGGTGGATCGGGT<br>GGAGGAGGAAGCGGTGGCGGGGGCAGCGAAATCGTGCTGACTCAGAGCCCGGGAACTCTTTCAC<br>TGTCCCCGGGAGAACGGGCCACTCTCTCGTGCCGGGCCACCCAGTCCATCGGCTCCTCCTTCCT<br>TGCCTGGTACCAGCAGAGGCCAGGACAGGCGCCCCGCCTGCTGATCTACGGTGCTTCCCAACGC<br>GCCACTGGCATTCCTGACCGGTTCAGCGGCAGAGGGTCGGGAACCGATTTCACACTGACCATTT<br>CCCGGGTGGAGCCCGAAGATTCGGCAGTCTACTACTGTCAGCATTACGAGTCCTCCCCTTCATG<br>GACCTTCGGTCAAGGGACCAAAGTGGAGATCAAG |
| BCMA_EBB-C1979-C12 -aa VH | 310 | EVQLVESGGGLVQPGRSLRLSCTASGFTFDDYAMHWVRQRPGKGLEWVASINWKGNSLAYGDSV<br>KGRFAISRDNAKNTVFLQMNSLRTEDTAVYYCASHQGVAYYNYAMDVWGRGTLVTVSS |

TABLE 11-continued

Amino Acid and Nucleic Acid Sequences of the anti-BCMA scFv domains and anti-BCMA CAR molecules

| Name/ Description | SEQ ID NO: | Sequence |
|---|---|---|
| BCMA_EBB-C1979-C12 - aa VL | 311 | EIVLTQSPGTLSLSPGERATLSCRATQSIGSSFLAWYQQRPGQAPRLLIYGASQRATGIPDRFS GRGSGTDFTLTISRVEPEDSAVYYCQHYESSPSWTFGQGTKVEIK |
| BCMA_EBB-C1979-C12 - aa Full CART | 312 | MALPVTALLLPLALLLHAARPEVQLVESGGGLVQPGRSLRLSCTASGFTFDDYAMHWVRQPGK GLEWVASINWKGNSLAYGDSVKGRFAISRDNAKNTVFLQMNSLRTEDTAVYYCASHQGVAYYNY AMDVWGRGTLVTVSSGGGGSGGGGSGGGGSEIVLTQSPGTLSLSPGERATLSCRATQSIGSSFL AWYQQRPGQAPRLLIYGASQRATGIPDRFSGRGSGTDFTLTISRVEPEDSAVYYCQHYESSPSW TFGQGTKVEIKTTTPAPRPPTPAPTIASQPLSLRPEACRPAAGGAVHTRGLDFACDIYIWAPLA GTCGVLLLSLVITLYCKRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |
| BCMA_EBB-C1979-C12 - nt Full CART | 313 | ATGGCCCTCCCTGTCACCGCCCTGCTGCTTCCGCTGGCTCTTCTGCTCCACGCCGCTCGGCCCG AAGTGCAGCTCGTGGAGAGCGGGGGAGGATTGGTGCAGCCCGGAAGGTCCCTGCGGCTCTCCTG CACTGCGTCTGGCTTCACCTTCGACGACTACGCGATGCACTGGGTCAGACAGCGCCCGGGAAAG GCCCTGGAATGGTCGCCTCAATCAACTGGAAGGGAAACTCCCTTGCCTATGGCGACAGCGTGA AGGGCCGCTTCGCCATTTCGCGCGACAACGCCAAGAACACCGTGTTTCTGCAAATGAATTCCCT GCGGACCGAGGATACCGCTGTGTACTACTGCGCCAGCCACCAGGGCGTGGCATACTATAACTAC GCCATGGACGTGTGGGGAAGAGGGACGCTCGTCACCGTGTCCTCCGGGGGCGGTGGATCGGGTG GAGGAGGAAGCGGTGGCGGGGGCAGCGAAATCGTGCTGACTCAGAGCCCGGGAACTCTTTCACT GTCCCCGGGAGAACGGGCCACTCTCTCGTGCCGGGCCACCCAGTCCATCGGCTCCTCCTTCCTT GCCTGGTACCAGCAGAGGCCAGGACAGGCGCCCCGCCTGCTGATCTACGGTGCTTCCCAACGCG CCACTGGCATTCCTGACCGGTTCAGCGGCAGAGGGTCGGGAACCGATTTCACACTGACCATTTC CCGGGTGGAGCCCGAAGATTCGGCAGTCTACTACTGTCAGCATTACGAGTCCTCCCCTTCATGG ACCTTCGGTCAAGGGACCAAAGTGGAGATCAAGACCACTACCCCAGCACCGAGGCCACCCACCC CGGCTCCTACCATCGCCTCCCAGCCTCTGTCCCTGCGTCCGGAGGCATGTAGACCCGCAGCTGG TGGGGCCGTGCATACCCGGGGTCTTGACTTCGCCTGCGATATCTACATTTGGGCCCCTCTGGCT GGTACTTGCGGGGTCCTGCTGCTTTCACTCGTGATCACTCTTTACTGTAAGCGCGGTCGGAAGA AGCTGCTGTACATCTTTAAGCAACCCTTCATGAGGCCTGTGCAGACTACTCAAGAGGAGGACGG CTGTTCATGCCGGTTCCCAGAGGAGGAGGAAGGCGGCTGCGAACTGCGCGTGAAATTCAGCGC AGCGCAGATGCTCCAGCCTACAAGCAGGGGCAGAACCAGCTCTACAACGAACTCAATCTTGGTC GGAGAGAGGAGTACGACGTGCTGGACAAGCGGAGAGGACGGGACCCAGAAATGGGCGGGAAGCC GCGCAGAAAGAATCCCCAAGAGGGCCTGTACAACGAGCTCCAAAAGGATAAGATGGCAGAAGCT TATAGCGAGATTGGTATGAAAGGGGAACGCAGAAGAGGCAAAGGCCACGACGGACTGTACCAGG GACTCAGCACCGCCACCAAGGACACCTATGACGCTCTTCACATGCAGGCCCTGCCGCCTCGG |

BCMA_EBB-C1980-G4

| Name/ Description | SEQ ID NO: | Sequence |
|---|---|---|
| BCMA_EBB-C1980-G4- aa ScFv domain | 314 | EVQLVESGGGLVQPGGSLRLSCAASGFTFSSYAMSWVRQAPGKGLEWVSAISGSGGST YYADSVKGRFTISRDNSKNTLYLQMNSLRAEDTAVYYCAKVVRDGMDVWGQGTTVT VSSGGGGSGGGGSGGGGSEIVLTQSPATLSLSPGERATLSCRASQSVSSSYLAWYQQKP GQAPRLLIYGASSRATGIPDRFSGNGSGTDFTLTISRLEPEDFAVYYCQQYGSPPRFTFGP GTKVDIK |
| BCMA_EBB-C1980-G4- nt ScFv domain | 315 | GAGGTGCAGTTGGTCGAAAGCGGGGGCGGGCTTGTGCAGCCTGGCGGATCACTGCGGCTGTCCT GCGCGGCCATCAGGCTTCACGTTTTCTTCCTACGCCATGTCCTGGGTGCGCCAGGCCCCTGGAAA GGGACTGGAATGGGTGTCCGCGATTTCGGGGTCCGGCGGGAGCACCTACTACGCCGATTCCGTG AAGGGCCGCTTCACTATCTCGCGGGACAACTCCAAGAACACCCTCTACCTCCAAATGAATAGCC TGCGGGCCGAGGATACCGCCGTCTACTATTGCGCTAAGGTCGTGCGCGACGGAATGGACGTGTG GGGACAGGGTACCACCGTGACAGTGTCCTCGGGGGGAGGCGGTAGCGGCGGAGGAGGAAGCGGT GGTGGAGGTTCCGAGATTGTGCTGACTCAATCACCCGCGACCCTGAGCCTGTCCCCGGCGAAA GGGCCACTCTGTCCTGTCGGGCCAGCCAATCAGTCTCCTCCTCGTACCTGGCCTGGTACCAGCA GAAGCCAGGACAGGCTCCGAGACTCCTTATCTATGGCGCATCCTCCCGCGCCACCGGAATCCCG GATAGGTTCTCGGGAAACGGATCGGGGACCGACTTCACTCTCACCATCTCCCGGCTGGAACGG AGGACTTCGCCGTGTACTACTGCCAGCAGTACGGCAGCCCGCCTAGATTCACTTTCGGCCCCGG CACCAAAGTGGACATCAAG |
| BCMA_EBB-C1980-G4- aa VH | 316 | EVQLVESGGGLVQPGGSLRLSCAASGFTFSSYAMSWVRQAPGKGLEWVSAISGSGGSTYYADSV KGRFTISRDNSKNTLYLQMNSLRAEDTAVYYCAKVVRDGMDVWGQGTTVTVSS |
| BCMA_EBB-C1980-G4- aa VL | 317 | EIVLTQSPATLSLSPGERATLSCRASQSVSSSYLAWYQQKPGQAPRLLIYGASSRATGIPDRFS GNGSGTDFTLTISRLEPEDFAVYYCQQYGSPPRFTFGPGTKVDIK |
| BCMA_EBB-C1980-G4- aa Full CART | 318 | MALPVTALLLPLALLLHAARPEVQLVESGGGLVQPGGSLRLSCAASGFTFSSYAMSWV RQAPGKGLEWVSAISGSGGSTYYADSVKGRFTISRDNSKNTLYLQMNSLRAEDTAVYY CAKVVRDGMDVWGQGTTVTVSSGGGGSGGGGSGGGGSEIVLTQSPATLSLSPGERATL SCRASQSVSSSYLAWYQQKPGQAPRLLIYGASSRATGIPDRFSGNGSGTDFTLTISRLEPE DFAVYYCQQYGSPPRFTFGPGTKVDIKTTTPAPRPPTPAPTIASQPLSLRPEACRPAAGGA VHTRGLDFACDIYIWAPLAGTCGVLLLSLVITLYCKRGRKKLLYIFKQPFMRPVQTTQEE |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| | | DGCSCRFPEEEEGGCELRVKFSRSADAPAYKQGQNQLYNELNLGRREEYDVLDKRRGR<br>DPEMGGKPRRKNPQEGLYNELQKDKMAEAYSEIGMKGERRRGKHDGLYQGLSTATK<br>DTYDALHMQALPPR |
| BCMA_EBB-C1980-G4- nt Full CART | 319 | ATGGCCCTCCCTGTCACCGCCCTGCTGCTTCCGCTGGCTCTTCTGCTCCACGCCGCTCGGCCCG<br>AGGTGCAGTTGGTCGAAAGCGGGGGCGGGCTTGTGCAGCCTGGCGGATCACTGCGGCTGTCCTG<br>CGCGGCATCAGGCTTCACGTTTTCTTCCTACGCCATGTCCTGGGTGCGCCAGGCCCCTGGAAAG<br>GGACTGGAATGGGTGTCCGCGATTTCGGGTCCGGCGGGAGCACCTACTACGCCGATTCCGTGA<br>AGGGCCGCTTCACTATCTCGCGGGACAACTCCAAGAACACCCTCTACCTCCAAATGAATAGCCT<br>GCGGGCCGAGGATACCGCCGTCTACTATTGCGCTAAGGTCGTGCGCGACGGAATGGACGTGTGG<br>GGACAGGGTACCACCGTGACAGTGTCCTCGGGGGGAGGCGGTAGCGGCGGAGGAGGAAGCGGTG<br>GTGGAGGTTCCGAGATTGTGCTGACTCAATCACCCGCGACCCTGAGCCTGTCCCCCGGCGAAAG<br>GGCCACTCTGTCCTGTCGGGCCAGCCAATCAGTCTCCTCCTCGTACCTGGCCTGGTACCAGCAG<br>AAGCCAGGACAGGCTCCGAGACTCCTTATCTATGGCGCATCCTCCCGCGCCACCGGAATCCCGG<br>ATAGGTTCTCGGGAAACGGATCGGGGACCGACTTCACTCTCACCATCTCCCGGCTGGAACCGGA<br>GGACTTCGCCGTGTACTACTGCCAGCAGTACGGCAGCCCGCCTAGATTCACTTTCGGCCCCGGC<br>ACCAAAGTGGACATCAAGACCACTACCCCAGCACCGAGGCCACCCACCCCGGCTCCTACCATCG<br>CCTCCCAGCCTCTGTCCCTGCGTCCGGAGGCATGTAGACCCGCAGCTGGTGGGGCCGTGCATAC<br>CCGGGGTCTTGACTTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAGCTGCTGTACATCT<br>TTAAGCAACCCTTCATGAGGCCTGTGCAGACTACTCAAGAGGAGGACGGCTGTTCATGCCGGTT<br>CCCAGAGGAGGAGGAAGGCGGCTGCGAACTGCGCGTGAAATTCAGCCGCAGCGCAGATGCTCCA<br>GCCTACAAGCAGGGGCAGAACCAGCTCTACAACGAACTCAATCTTGGTCGGAGAGAGGAGTACG<br>ACGTGCTGGACAAGCGGAGAGGACGGGACCCAGAAATGGGCGGGAAGCCGCGCAGAAAGAATCC<br>CCAAGAGGGCCTGTACAACGAGCTCCAAAAGGATAAGATGGCAGAAGCCTATAGCGAGATTGGT<br>ATGAAAGGGGAACGCAGAAGAGGCAAAGGCCACGACGGACTGTACCAGGGACTCAGCACCGCCA<br>CCAAGGACACCTATGACGCTCTTCACATGCAGGCCCTGCCGCCTCGG |
| | | BCMA_EBB-C1980-D2 |
| BCMA_EBB-C1980-D2- aa ScFv domain | 320 | EVQLLESGGGLVQPGGSLRLSCAASGFTFSSYAMSWVRQAPGKGLEWVSAISGSGGSTYYADSV<br>KGRFTISRDNSKNTLYLQMNSLRAEDTAVYYCAKIPQTGTFDYWGQGTLVTVSSGGGGSGGGGS<br>GGGGSEIVLTQSPGTLSLSPGERATLSCRASQSVSSSYLAWYQQRPGQAPRLLIYGASSRATGI<br>PDRFSGSGSGTDFTLTISRLEPEDFAVYYCQHYGSSPSWTFGQGTRLEIK |
| BCMA_EBB-C1980-D2- nt ScFv domain | 321 | GAAGTGCAGCTGCTGGAGTCCGGCGGTGGATTGGTGCAACCGGGGGGATCGCTCAGACTGTCCT<br>GTGCGGCGTCAGGCTTCACCTTCTCGAGCTACGCCATGTCATGGGTCAGACAGGCCCCTGGAAA<br>GGGTCTGGAATGGGTGTCCGCCATTTCCGGGAGCGGGGGATCTACATACTACGCCGATAGCGTG<br>AAGGGCCGCTTCACCATTTCCCGGGACAACTCCAAGAACACTCTCTATCTGCAAATGAACTCCC<br>TCCGCGCTGAGGACACTGCCGTGTACTACTGCGCCAAAATCCCTCAGACCGGCACCTTCGACTA<br>CTGGGGACAGGGGACTCTGGTCACCGTCAGCAGCGGTGGCGGAGGTTCGGGGGGAGGAGGAAGC<br>GGCGGCGGAGGGTCCGAGATTGTGCTGACCCAGTCACCCGGCACTTTGTCCCTGTCGCCTGGAG<br>AAAGGGCCACCCTTTCCTGCCGGGCATCCAATCGTGTCCTCCTCGTACCTGGCCTGGTACCA<br>GCAGAGGCCCGGACAGGCCCCACGGCTTCTGATCTACGGAGCAAGCAGCCGCGCGACCGGTATC<br>CCGGACCGGTTTTCGGGCTCGGGCTCAGGAACTGACTTCACCCTCACCATCTCCCGCCTGGAAC<br>CCGAAGATTTCGCTGTGTATTACTGCCAGCACTACGGCAGCTCCCCGTCCTGGACGTTCGGCCA<br>GGGAACTCGGCTGGAGATCAAG |
| BCMA_EBB-C1980-D2- aa VH | 322 | EVQLLESGGGLVQPGGSLRLSCAASGFTFSSYAMSWVRQAPGKGLEWVSAISGSGGSTYYADSV<br>KGRFTISRDNSKNTLYLQMNSLRAEDTAVYYCAKIPQTGTFDYWGQGTLVTVSS |
| BCMA_EBB-C1980-D2- aa VL | 323 | EIVLTQSPGTLSLSPGERATLSCRASQSVSSSYLAWYQQRPGQAPRLLIYGASSRATGIPDRFS<br>GSGSGTDFTLTISRLEPEDFAVYYCQHYGSSPSWTFGQGTRLEIK |
| BCMA_EBB-C1980 -D2- aa Full CART | 324 | MALPVTALLLPLALLLHAARPEVQLLESGGGLVQPGGSLRLSCAASGFTFSSYAMSWVRQAPGK<br>GLEWVSAISGSGGSTYYADSVKGRFTISRDNSKNTLYLQMNSLRAEDTAVYYCAKIPQTGTFDY<br>WGQGTLVTVSSGGGGSGGGGSGGGGSEIVLTQSPGTLSLSPGERATLSCRASQSVSSSYLAWYQ<br>QRPGQAPRLLIYGASSRATGIPDRFSGSGSGTDFTLTISRLEPEDFAVYYCQHYGSSPSWTFGQ<br>GTRLEIKTTTPAPRPPTPAPTIASQPLSLRPEACRPAAGGAVHTRGLDFACDIYIWAPLAGTCG<br>VLLLSLVITLYCKRGRKKLLYIFKQPFMRPVQTTQEEDGCSCRFPEEEEGGCELRVKFSRSADA<br>PAYKQGQNQLYNELNLGRREEYDVLDKRRGRDPEMGGKPRRKNPQEGLYNELQKDKMAEAYSEI<br>GMKGERRRGKHDGLYQGLSTATKDTYDALHMQALPPR |
| BCMA_EBB-C1980-D2- nt Full CART | 325 | ATGGCCCTCCCTGTCACCGCCCTGCTGCTTCCGCTGGCTCTTCTGCTCCACGCCGCTCGGCCCG<br>AAGTGCAGCTGCTGGAGTCCGGCGGTGGATTGGTGCAACCGGGGGGATCGCTCAGACTGTCCTG<br>TGCGGCGTCAGGCTTCACCTTCTCGAGCTACGCCATGTCATGGGTCAGACAGGCCCCTGGAAAG<br>GGTCTGGAATGGGTGTCCGCCATTTCCGGGAGCGGGGGATCTACATACTACGCCGATAGCGTGA<br>AGGGCCGCTTCACCATTTCCCGGGACAACTCCAAGAACACTCTCTATCTGCAAATGAACTCCCT<br>CCGCGCTGAGGACACTGCCGTGTACTACTGCGCCAAAATCCCTCAGACCGGCACCTTCGACTAC<br>TGGGGACAGGGGACTCTGGTCACCGTCAGCAGCGGTGGCGGAGGTTCGGGGGGAGGAGGAAGCG<br>GCGGCGGAGGGTCCGAGATTGTGCTGACCCAGTCACCCGGCACTTTGTCCCTGTCGCCTGGAGA |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | AAGGGCCACCCTTTCCTGCCGGGCATCCCAATCCGTGTCCTCCTCGTACCTGGCCTGGTACCAG<br>CAGAGGCCCGGACAGGCCCCACGGCTTCTGATCTACGGAGCAAGCAGCCGCGCGACCGGTATCC<br>CGGACCGGTTTTCGGGCTCGGGCTCAGGAACTGACTTCACCCTCACCATCTCCCGCCTGGAACC<br>CGAAGATTTCGCTGTGTATTACTGCCAGCACTACGGCAGCTCCCCGTCCTGGACGTTCGGCCAG<br>GGAACTCGGCTGGAGATCAAGACCACTACCCCAGCACCGAGGCCACCCACCCCGGCTCCTACCA<br>TCGCCTCCCAGCCTCTGTCCCTGCGTCCGGAGGCATGTAGACCCGCAGCTGGTGGGGCCGTGCA<br>TACCCGGGGTCTTGACTTCGCCTGCGATATCTACATTTGGGCCCCTCTGGCTGGTACTTGCGGG<br>GTCCTGCTGCTTTCACTCGTGATCACTCTTTACTGTAAGCGCGGTCGGAAGAAGCTGCTGTACA<br>TCTTTAAGCAACCCTTCATGAGGCCTGTGCAGACTACTCAAGAGGAGGACGGCTGTTCATGCCG<br>GTTCCCAGAGGAGGAGGAAGGCGGCTGCGAACTGCGCGTGAAATTCAGCCGCAGCGCAGATGCT<br>CCAGCCTACAAGCAGGGGCAGAACCAGCTCTACAACGAACTCAATCTTGGTCGGAGAGAGGAGT<br>ACGACGTGCTGGACAAGCGGAGAGGACGGGACCCAGAAATGGGCGGGAAGCCGCGCAGAAAGAA<br>TCCCCAAGAGGGCTGTACAACGAGCTCCAAAAGGATAAGATGGCAGAAGCCTATAGCGAGATT<br>GGTATGAAAGGGGAACGCAGAAGAGGCAAAGGCCACGACGGACTGTACCAGGGACTCAGCACCG<br>CCACCAAGGACACCTATGACGCTCTTCACATGCAGGCCCTGCCGCCTCGG |

BCMA_EBB-C1978-A10

| BCMA_EBB-<br>C1978-A10-<br>aa<br>ScFv domain | 326 | EVQLVETGGGLVQPGGSLRLSCAASGFTFSSYAMSWVRQAPGKGLEWVSAISGSGGST<br>YYADSVKGRFTMSRENDKNSVFLQMNSLRVEDTGVYYCARANYKRELRYYYGMDVW<br>GQGTMVTVSSGGGGSGGGGSGGGGSEIVMTQSPGTLSLSPGESATLSCRASQRVASNYL<br>AWYQHKPGQAPSLLISGASSRATGVPDRFSGSGSGTDFTLAISRLEPEDSAVYYCQHYDS<br>SPSWTFGQGTKVEIK |
| BCMA_EBB-<br>C1978-A10-<br>nt<br>ScFv domain | 327 | GAAGTGCAACTGGTGGAAACCGGTGGAGGACTCGTGCAGCCTGGCGGCAGCCTCCGGCTGAGCT<br>GCGCCGCTTCGGGATTCACCTTTTCCTCCTACGCGATGTCTTGGGTCAGACAGGCCCCCGGAAA<br>GGGGCTGGAATGGGTGTCAGCCATCTCCGGCTCCGGCGGATCAACGTACTACGCCGACTCCGTG<br>AAAGGCCGGTTCACCATGTCGCGCGAGAATGACAAGAACTCCGTGTTCCTGCAAATGAACTCCC<br>TGAGGGTGGAGGACACCGGAGTGTACTATTGTGCGCGCGCCAACTACAAGAGAGAGCTGCGGTA<br>CTACTACGGAATGGACGTCTGGGGACAGGGAACTATGGTGACCGTGTCATCCGGTGGAGGGGGA<br>AGCGGCGGTGGAGGCAGCGGGGGCGGGGGTTCAGAAATTGTCATGACCCAGTCCCCGGGAACTC<br>TTTCCCTCTCCCCCGGGGAATCCGCGACTTTGTCCTGCCGGGCCAGCCAGCGCGTGGCCTCGAA<br>CTACCTCGCATGGTACCAGCATAAGCCAGGCCAAGCCCCTTCCCTGCTGATTTCCGGGGCTAGC<br>AGCCGCGCCACTGGCGTGCCGGATAGGTTCTCGGGAAGCGGCTCGGGTACCGATTTCACCCTGG<br>CAATCTCGCGGCTGGAACCGGAGGATTCGGCCGTGTACTACTGCCAGCACTATGACTCATCCCC<br>CTCCTGGACATTCGGACAGGGCACCAAGGTCGAGATCAAG |
| BCMA_EBB-<br>C1978-A10-<br>aa<br>VH | 328 | EVQLVETGGGLVQPGGSLRLSCAASGFTFSSYAMSWVRQAPGKGLEWVSAISGSGGSTYYADSV<br>KGRFTMSRENDKNSVFLQMNSLRVEDTGVYYCARANYKRELRYYYGMDVWGQGTMVTVSS |
| BCMA_EBB-<br>C1978-A10-<br>aa<br>VL | 329 | EIVMTQSPGTLSLSPGESATLSCRASQRVASNYLAWYQHKPGQAPSLLISGASSRATGVPDRFS<br>GSGSGTDFTLAISRLEPEDSAVYYCQHYDSSPSWTFGQGTKVEIK |
| BCMA_EBB-<br>C1978-A10-<br>aa<br>Full CART | 330 | MALPVTALLLPLALLLHAARPEVQLVETGGGLVQPGGSLRLSCAASGFTFSSYAMSWV<br>RQAPGKGLEWVSAISGSGGSTYYADSVKGRFTMSRENDKNSVFLQMNSLRVEDTGVY<br>YCARANYKRELRYYYGMDVWGQGTMVTVSSGGGGSGGGGSGGGGSEIVMTQSPGTL<br>SLSPGESATLSCRASQRVASNYLAWYQHKPGQAPSLLISGASSRATGVPDRFSGSGSGTD<br>FTLAISRLEPEDSAVYYCQHYDSSPSWTFGQGTKVEIKTTTPAPRPPTPAPTIASQPLSRP<br>EACRPAAGGAVHTRGLDFACDIYIWAPLAGTCGVLLLSLVITLYCKRGRKKLLYIFKQP<br>FMRPVQTTQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERRRGKGH<br>DGLYQGLSTATKDTYDALHMQALPPR |
| BCMA_EBB-<br>C1978-A10-<br>nt<br>Full CART | 331 | ATGGCCCTCCCTGTCACCGCCCTGCTGCTTCCGCTGGCTCTTCTGCTCCACGCCGCTCGGCCCG<br>AAGTGCAACTGGTGGAAACCGGTGGAGGACTCGTGCAGCCTGGCGGCAGCCTCCGGCTGAGCTG<br>CGCCGCTTCGGGATTCACCTTTTCCTCCTACGCGATGTCTTGGGTCAGACAGGCCCCCGGAAAG<br>GGGCTGGAATGGGTGTCAGCCATCTCCGGCTCCGGCGGATCAACGTACTACGCCGACTCCGTGA<br>AAGGCCGGTTCACCATGTCGCGCGAGAATGACAAGAACTCCGTGTTCCTGCAAATGAACTCCCT<br>GAGGGTGGAGGACACCGGAGTGTACTATTGTGCGCGCGCCAACTACAAGAGAGAGCTGCGGTAC<br>TACTACGGAATGGACGTCTGGGGACAGGGAACTATGGTGACCGTGTCATCCGGTGGAGGGGGAA<br>GCGGCGGTGGAGGCAGCGGGGGCGGGGGTTCAGAAATTGTCATGACCCAGTCCCCGGGAACTCT<br>TTCCCTCTCCCCCGGGGAATCCGCGACTTTGTCCTGCCGGGCCAGCCAGCGCGTGGCCTCGAAC<br>TACCTCGCATGGTACCAGCATAAGCCAGGCCAAGCCCCTTCCCTGCTGATTTCCGGGGCTAGCA<br>GCCGCGCCACTGGCGTGCCGGATAGGTTCTCGGGAAGCGGCTCGGGTACCGATTTCACCCTGGC<br>AATCTCGCGGCTGGAACCGGAGGATTCGGCCGTGTACTACTGCCAGCACTATGACTCATCCCCC<br>TCCTGGACATTCGGACAGGGCACCAAGGTCGAGATCAAGACCACTACCCCAGCACCGAGGCCAC<br>CCACCCCGGCTCCTACCATCGCCTCCCAGCCTCTGTCCCTGCGTCCGGAGGCATGTAGACCCGC<br>AGCTGGTGGGGCCGTGCATACCCGGGGTCTTGACTTCGCCTGCGATATCTACATTTGGGCCCCT<br>CTGGCTGGTACTTGCGGGGTCCTGCTGCTTTCACTCGTGATCACTCTTTACTGTAAGCGCGGTC |

TABLE 11-continued

Amino Acid and Nucleic Acid Sequences of the anti-BCMA scFv domains and anti-BCMA CAR molecules

| Name/<br>Description | SEQ<br>ID<br>NO: | Sequence |
|---|---|---|
| | | GGAAGAAGCTGCTGTACATCTTTAAGCAACCCTTCATGAGGCCTGTGCAGACTACTCAAGAGGA<br>GGACGGCTGTTCATGCCGGTTCCCAGAGGAGGAGGAAGGCGGCTGCGAACTGCGCGTGAAATTC<br>AGCCGCAGCGCAGATGCTCCAGCCTACAAGCAGGGGCAGAACCAGCTCTACAACGAACTCAATC<br>TTGGTCGGAGAGAGGAGTACGACGTGCTGGACAAGCGGAGAGGACGGGACCCAGAAATGGGCGG<br>GAAGCCGCGCAGAAAGAATCCCCAAGAGGGCCTGTACAACGAGCTCCAAAAGGATAAGATGGCA<br>GAAGCCTATAGCGAGATTGGTATGAAAGGGGAACGCAGAAGAGGCAAAGGCCACGACGGACTGT<br>ACCAGGGACTCAGCACCGCCACCAAGGACACCTATGACGCTCTTCACATGCAGGCCCTGCCGCC<br>TCGG |

BCMA_EBB-C1978-D4

| Name/<br>Description | SEQ<br>ID<br>NO: | Sequence |
|---|---|---|
| BCMA_EBB-<br>C1978-D4- aa<br>ScFv domain | 332 | EVQLLETGGGLVQPGGSLRLSCAASGFSFSSYAMSWVRQAPGKGLEWVSAISGSGGSTYYADSV<br>KGRFTISRDNSKNTLYLQMNSLRAEDTAVYYCAKALVGATGAFDIWGQGTLVTVSSGGGGSGGG<br>GSGGGGSEIVLTQSPGTLSLSPGERATLSCRASQSLSSNFLAWYQQKPGQAPGLLIYGASNWAT<br>GTPDRFSGSGSGTDFTLTITRLEPEDFAVYYCQYYGTSPMYTFGQGTKVEIK |
| BCMA_EBB-<br>C1978-D4- nt<br>ScFv domain | 333 | GAAGTGCAGCTGCTCGAAACCGGTGGAGGGCTGGTGCAGCCAGGGGGCTCCCTGAGGCTTTCAT<br>GCGCCGCTAGCGGATTCTCCTTCTCCTCTTACGCCATGTCGTGGGTCCGCCAAGCCCCTGGAAA<br>AGGCCTGGAATGGGTGTCCGCGATTTCCGGGAGCGGAGGTTCGACCTATTACGCCGACTCCGTG<br>AAGGGCCGCTTTACCATCTCCCGGGATAACTCCAAGAACACTCTGTACCTCCAAATGAACTCGC<br>TGAGAGCCGAGGACACCGCCGTGTATTACTGCGCGAAGGCGCTGGTCGGCGCGACTGGGGCATT<br>CGACATCTGGGGACAGGGAACTCTTGTGACCGTGTCGAGCGGAGGCGGCGGCTCCGGCGGAGGA<br>GGGAGCGGGGGCGGTGGTTCCGAAATCGTGTTGACTCAGTCCCCGGGAACCCTGAGCTTGTCAC<br>CGGGGAGCGGGCCACTCTCTCCTGTCGCGCCTCCCAATCGCTCTCATCCAATTTCCTGGCCTG<br>GTACCAGCAGAAGCCCGGACAGGCCCCGGGCCTGCTCATCTACGGCGCTTCAAACTGGGCAACG<br>GGAACCCCTGATCGGTTCAGCGGAAGCGGATCGGGTACTGACTTTACCCTGACCATCACCAGAC<br>TGGAACCGGAGGACTTCGCCGTGTACTACTGCCAGTACTACGGCACCTCCCCCATGTACACATT<br>CGGACAGGGTACCAAGGTCGAGATTAAG |
| BCMA_EBB-<br>C1978-D4- aa<br>VH | 334 | EVQLLETGGGLVQPGGSLRLSCAASGFSFSSYAMSWVRQAPGKGLEWVSAISGSGGSTYYADSV<br>KGRFTISRDNSKNTLYLQMNSLRAEDTAVYYCAKALVGATGAFDIWGQGTLVTVSS |
| BCMA_EBB-<br>C1978-D4- aa<br>VL | 335 | EIVLTQSPGTLSLSPGERATLSCRASQSLSSNFLAWYQQKPGQAPGLLIYGASNWATGTPDRFS<br>GSGSGTDFTLTITRLEPEDFAVYYCQYYGTSPMYTFGQGTKVEIK |
| BCMA_EBB-<br>C1978-D4- aa<br>Full CART | 336 | MALPVTALLLPLALLLHAARPEVQLLETGGGLVQPGGSLRLSCAASGFSFSSYAMSWVRQAPGK<br>GLEWVSAISGSGGSTYYADSVKGRFTISRDNSKNTLYLQMNSLRAEDTAVYYCAKALVGATGAF<br>DIWGQGTLVTVSSGGGGSGGGGSGGGGSEIVLTQSPGTLSLSPGERATLSCRASQSLSSNFLAW<br>YQQKPGQAPGLLIYGASNWATGTPDRFSGSGSGTDFTLTITRLEPEDFAVYYCQYYGTSPMYTF<br>GQGTKVEIKTTTPAPRPPTPAPTIASQPLSLRPEACRPAAGGAVHTRGLDFACDIYIWAPLAGT<br>CGVLLLSLVITLYCKRGRKKLLYIFKQPFMRPVQTTQEEDGCSCRFPEEEEGGCELRVKFSRSA<br>DAPAYKQGQNQLYNELNLGRREEYDVLDKRRGRDPEMGGKPRRKNPQEGLYNELQKDKMAEAYS<br>EIGMKGERRRGKHDGLYQGLSTATKDTYDALHMQALPPR |
| BCMA_EBB-<br>C1978-D4- nt<br>Full CART | 337 | ATGGCCCTCCCTGTCACCGCCCTGCTGCTTCCGCTGGCTCTTCTGCTCCACGCCGCTCGGCCCG<br>AAGTGCAGCTGCTCGAAACCGGTGGAGGGCTGGTGCAGCCAGGGGGCTCCCTGAGGCTTTCATG<br>CGCCGCTAGCGGATTCTCCTTCTCCTCTTACGCCATGTCGTGGGTCCGCCAAGCCCCTGGAAAA<br>GGCCTGGAATGGGTGTCCGCGATTTCCGGGAGCGGAGGTTCGACCTATTACGCCGACTCCGTGA<br>AGGGCCGCTTTACCATCTCCCGGGATAACTCCAAGAACACTCTGTACCTCCAAATGAACTCGCT<br>GAGAGCCGAGGACACCGCCGTGTATTACTGCGCGAAGGCGCTGGTCGGCGCGACTGGGGCATTC<br>GACATCTGGGGACAGGGAACTCTTGTGACCGTGTCGAGCGGAGGCGGCGGCTCCGGCGGAGGAG<br>GGAGCGGGGGCGGTGGTTCCGAAATCGTGTTGACTCAGTCCCCGGGAACCCTGAGCTTGTCACC<br>CGGGGAGCGGGCCACTCTCTCCTGTCGCGCCTCCCAATCGCTCTCATCCAATTTCCTGGCCTGG<br>TACCAGCAGAAGCCCGGACAGGCCCCGGGCCTGCTCATCTACGGCGCTTCAAACTGGGCAACGG<br>GAACCCCTGATCGGTTCAGCGGAAGCGGATCGGGTACTGACTTTACCCTGACCATCACCAGACT<br>GGAACCGGAGGACTTCGCCGTGTACTACTGCCAGTACTACGCCACCTCCCCCATGTACACATTC<br>GGACAGGGTACCAAGGTCGAGATTAAGACCACTACCCCAGCACCGAGGCCACCCACCCCGGCTC<br>CTACCATCGCCTCCCAGCCTCTGTCCCTGCGTCGGAGGCATGTAGACCCGCAGCTGGTGGGGC<br>CGTGCATACCCGGGGTCTTGACTTCGCCTGCATATCTACATTTGGGCCCCTCTGGCTGGTACT<br>TGCGGGGTCCTGCTGCTTTCACTCGTGATCACTCTTTACTGTAAGCGCGGTCGGAAGAAGCTGC<br>TGTACATCTTTAAGCAACCCTTCATGAGGCCTGTGCAGACTACTCAAGAGGAGGACGGCTGTTC<br>ATGCCGGTTCCCAGAGGAGGAGGAAGGCGGCTGCGAACTGCGCGTGAAATTCAGCCGCAGCGCA<br>GATGCTCCAGCCTACAAGCAGGGGCAGAACCAGCTCTACAACGAACTCAATCTTGGTCGGAGAG<br>AGGAGTACGACGTGCTGGACAAGCGGAGAGGACGGGACCCAGAAATGGGCGGGAAGCCGCGCAG<br>AAAGAATCCCCAAGAGGGCCTGTACAACGAGCTCCAAAAGGATAAGATGGCAGAAGCCTATAGC<br>GAGATTGGTATGAAAGGGGAACGCAGAAGAGGCAAAGGCCACGACGGACTGTACCAGGGACTCA<br>GCACCGCCACCAAGGACACCTATGACGCTCTTCACATGCAGGCCCTGCCGCCTCGG |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| BCMA_EBB-C1980-A2 | | |
| BCMA_EBB-C1980-A2- aa ScFv domain | 338 | EVQLLESGGGLVQPGGSLRLSCAASGFTFSSYAMSWVRQAPGKGLEWVSAISGSGGSTYYADSV KGRFTISRDNSKNTLYLQMNSLRAEDTAVYYCVLWFGEGFDPWGQGTLVTVSSGGGGSGGGGSG GGGSDIVLTQSPLSLPVTPGEPASISCRSSQSLLHSNGYNYLDWYLQKPGQSPQLLIYLGSNRA SGVPDRFSGSGSGTDFTLKISRVEAEDVGVYYCMQALQTPLTFGGGTKVDIK |
| BCMA_EBB-C1980-A2- nt ScFv domain | 339 | GAAGTGCAGCTGCTTGAGAGCGGTGGAGGTCTGGTGCAGCCCGGGGGATCACTGCGCCTGTCCT GTGCCGCGTCCGGTTTCACTTTCTCCTCGTACGCCATGTCGTGGGTCAGACAGGCACCGGGAAA GGGACTGGAATGGGTGTCAGCCATTTCGGGTTCGGGGGGCAGCACCTACTACGCTGACTCCGTG AAGGGCCGGTTCACCATTTCCCGCGACAACTCCAAGAACACCTTGTACCTCCAAATGAACTCCC TGCGGGCCGAAGATACCGCCGTGTATTACTGCGTGCTGTGGTTCGGAGAGGGATTCGACCCGTG GGGACAAGGAACACTCGTGACTGTGTCATCCGGCGGAGGCGGCAGCGGTGGCGGCGGTTCCGGC GGCGGCGGATCTGACATCGTGTTGACCCAGTCCCCTCTGAGCCTGCCGGTCACTCCTGGCGAAC CAGCCAGCATCTCCTGCCGGTCGAGCCAGTCCCTCCTGCACTCCAATGGGTACAACTACCTCGA TTGGTATCTGCAAAAGCCGGGCCAGAGCCCCCAGCTGCTGATCTACCTTGGGTCAAACCGCGCT TCCGGGGTGCCTGATAGATTCTCCGGGTCCGGGAGCGGAACCGACTTTACCCTGAAAATCTCGA GGGTGGAGGCCGAGGACGTCGGAGTGTACTACTGCATGCAGGCGCTCCAGACTCCCCTGACCTT CGGAGGAGGAACGAAGGTCGACATCAAGA |
| BCMA_EBB-C1980-A2- aa VH | 340 | EVQLLESGGGLVQPGGSLRLSCAASGFTFSSYAMSWVRQAPGKGLEWVSAISGSGGSTYYADSV KGRFTISRDNSKNTLYLQMNSLRAEDTAVYYCVLWFGEGFDPWGQGTLVTVSS |
| BCMA_EBB-C1980-A2- aa VL | 341 | DIVLTQSPLSLPVTPGEPASISCRSSQSLLHSNGYNYLDWYLQKPGQSPQLLIYLGSNRASGVP DRFSGSGSGTDFTLKISRVEAEDVGVYYCMQALQTPLTFGGGTKVDIK |
| BCMA_EBB-C1980-A2- aa Full CART | 342 | MALPVTALLLPLALLLHAARPEVQLLESGGGLVQPGGSLRLSCAASGFTFSSYAMSWVRQAPGK GLEWVSAISGSGGSTYYADSVKGRFTISRDNSKNTLYLQMNSLRAEDTAVYYCVLWFGEGFDPW GQGTLVTVSSGGGGSGGGGSGGGGSDIVLTQSPLSLPVTPGEPASISCRSSQSLLHSNGYNYLD WYLQKPGQSPQLLIYLGSNRASGVPDRFSGSGSGTDFTLKISRVEAEDVGVYYCMQALQTPLTF GGGTKVDIKTTTPAPRPPTPAPTIASQPLSLRPEACRPAAGGAVHTRGLDFACDIYIWAPLAGT CGVLLLSLVITLYCKRGRKKLLYIFKQPFMRPVQTTQEEDGCSCRFPEEEEGGCELRVKFSRSA DAPAYKQGQNQLYNELNLGRREEYDVLDKRRGRDPEMGGKPRRKNPQEGLYNELQKDKMAEAYS EIGMKGERRRGKGHDGLYQGLSTATKDTYDALHMQALPPR |
| BCMA_EBB-C1980-A2- nt Full CART | 343 | ATGGCCCTCCCTGTCACCGCCCTGCTGCTTCCGCTGGCTCTTCTGCTCCACGCCGCTCGGCCCG AAGTGCAGCTGCTTGAGAGCGGTGGAGGTCTGGTGCAGCCCGGGGGATCACTGCGCCTGTCCTG TGCCGCGTCCGGTTTCACTTTCTCCTCGTACGCCATGTCGTGGGTCAGACAGGCACCGGGAAAG GGACTGGAATGGGTGTCAGCCATTTCGGGTTCGGGGGGCAGCACCTACTACGCTGACTCCGTGA AGGGCCGGTTCACCATTTCCCGCGACAACTCCAAGAACACCTTGTACCTCCAAATGAACTCCCT GCGGGCCGAAGATACCGCCGTGTATTACTGCGTGCTGTGGTTCGGAGAGGGATTCGACCCGTGG GGACAAGGAACACTCGTGACTGTGTCATCCGGCGGAGGCGGCAGCGGTGGCGGCGGTTCCGGCG GCGGCGGATCTGACATCGTGTTGACCCAGTCCCCTCTGAGCCTGCCGGTCACTCCTGGCGAACC AGCCAGCATCTCCTGCCGGTCGAGCCAGTCCCTCCTGCACTCCAATGGGTACAACTACCTCGAT TGGTATCTGCAAAAGCCGGGCCAGAGCCCCCAGCTGCTGATCTACCTTGGGTCAAACCGCGCTT CCGGGGTGCCTGATAGATTCTCCGGGTCCGGGAGCGGAACCGACTTTACCCTGAAAATCTCGAG GGTGGAGGCCGAGGACGTCGGAGTGTACTACTGCATGCAGGCGCTCCAGACTCCCCTGACCTTC GGAGGAGGAACGAAGGTCGACATCAAGACCACTACCCCAGCACCGAGGCCACCACCCCGGCTG CTACCATCGCCTCCCAGCCTCTGTCCCTGCGTCCGGAGGCATGTAGACCCGCAGCTGGTGGGC CGTGCATACCCGGGTCTTGACTTCGCCTGCGATATCTACATTTGGGCCCCTCTGGCTGGTACT TGCGGGGTCCTGCTGCTTTCACTCGTGATCACTCTTTACTGTAAGCGCGGTCGGAAGAAGCTGC TGTACATCTTTAAGCAACCCTTCATGAGGCCTGTGCAGACTACTCAAGAGGAGGACGGCTGTTC ATGCCGGTTCCCAGAGGAGGAGGAAGGCGGCTGCGAACTGCGCGTGAAATTCAGCCGCAGCGCA GATGCTCCAGCCTACAAGCAGGGGCAGAACCAGCTCTACAACGAACTCAATCTTGGTCGGAGAG AGGAGTACGACGTGCTGGACAAGCGGAGAGGACGGGACCCAGAAATGGGCGGGAAGCCGCGCAG AAAGAATCCCCAAGAGGGCCTGTACAACGAGCTCCAAAAGGATAAGATGGCAGAAGCCTATAGC GAGATTGGTATGAAAGGGGAACGCAGAAGAGGCAAAGGCCACGACGGACTGTACCAGGGACTCA GCACCGCCACCAAGGACACCTATGACGCTCTTCACATGCAGGCCCTGCCGCCTCGG |
| BCMA_EBB-C1981-C3 | | |
| BCMA_EBB-C1981-C3- aa ScFv domain | 344 | QVQLVESGGGLVQPGGSLRLSCAASGFTFSSYAMSWVRQAPGKGLEWVSAISGSGGSTYYADSV KGRFTISRDNSKNTLYLQMNSLRAEDTAVYYCAKVGYDSSGYYRDYYGMDVWGQGTTVTVSSGG GGSGGGGSGGGGSEIVLTQSPGTLSLSPGERATLSCRASQSVSSSYLAWYQQKPGQAPRLLIYG TSSRATGISDRFSGSGSGTDFTLTISRLEPEDFAVYYCQHYGNSPPKFTFGPGTKLEIK |
| BCMA_EBB-C1981-C3- nt ScFv domain | 345 | CAAGTGCAGCTCGTGGAGTCAGGCGGAGGACTGGTGCAGCCCGGGGGCTCCCTGAGACTTTCCT GCGCGGCATCGGGTTTTACCTTCTCCTCCTATGCTATGTCCTGGGTGCGCCAGGCCCCGGGAAA GGGACTGGAATGGGTGTCGCAATCAGCGGTAGCGGGGCTCAACATACTACGCCGACTCCGTC AAGGGTCGCTTCACTATTTCCCGGGACAACTCCAAGAATACCCTGTACCTCCAAATGAACAGCC |

TABLE 11-continued

Amino Acid and Nucleic Acid Sequences of the anti-BCMA scFv domains and anti-BCMA CAR molecules

| Name/Description | SEQ ID NO: | Sequence |
|---|---|---|
| | | TCAGGGCCGAGGATACTGCCGTGTACTACTGCGCCAAAGTCGGATACGATAGCTCCGGTTACTA<br>CCGGGACTACTACGGAATGGACGTGTGGGGACAGGGCACCACCGTGACCGTGTCAAGCGGCGGA<br>GGCGGTTCAGGAGGGGGAGGCTCCGGCGGTGGAGGGTCCGAAATCGTCCTGACTCAGTCGCCTG<br>GCACTCTGTCGTTGTCCCCGGGGAGCGCGCTACCCTGTCGTGTCGGGCGTCGCAGTCCGTGTC<br>GAGCTCCTACCTCGCGTGGTACCAGCAGAAGCCCGGACAGGCCCCTAGACTTCTGATCTACGGC<br>ACTTCTTCACGCGCCACCGGGATCAGCGACAGGTTCAGCGGCTCCGGCTCCGGGACCGACTTCA<br>CCCTGACCATTAGCCGGCTGGAGCCTGAAGATTTCGCCGTGTATTACTGCCAACACTACGGAAA<br>CTCGCCGCCAAAGTTCACGTTCGGACCCGGAACCAAGCTGGAAATCAAG |
| BCMA_EBB-C1981-C3- aa VH | 346 | QVQLVESGGGLVQPGGSLRLSCAASGFTFSSYAMSWVRQAPGKGLEWVSAISGSGGSTYYADSV<br>KGRFTISRDNSKNTLYLQMNSLRAEDTAVYYCAKVGYDSSGYYRDYYGMDVWGQGTTVTVSS |
| BCMA_EBB-C1981-C3- aa VL | 347 | EIVLTQSPGTLSLSPGERATLSCRASQSVSSSYLAWYQQKPGQAPRLLIYGTSSRATGISDRFS<br>GSGSGTDFTLTISRLEPEDFAVYYCQHYGNSPPKFTFGPGTKLEIK |
| BCMA_EBB-C1981-C3- aa Full CART | 348 | MALPVTALLLPLALLLHAARPQVQLVESGGGLVQPGGSLRLSCAASGFTFSSYAMSWVRQAPGK<br>GLEWVSAISGSGGSTYYADSVKGRFTISRDNSKNTLYLQMNSLRAEDTAVYYCAKVGYDSSGYY<br>RDYYGMDVWGQGTTVTVSSGGGGSGGGGSGGGGSEIVLTQSPGTLSLSPGERATLSCRASQSVS<br>SSYLAWYQQKPGQAPRLLIYGTSSRATGISDRFSGSGSGTDFTLTISRLEPEDFAVYYCQHYGN<br>SPPKFTFGPGTKLEIKTTTPAPRPPTPAPTIASQPLSLRPEACRPAAGGAVHTRGLDFACDIYI<br>WAPLAGTCGVLLLSLVITLYCKRGRKKLLYIFKQPFMRPVQTTQEEDGCSCRFPEEEEGGCELR<br>VKFSRSADAPAYKQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| BCMA_EBB-C1981-C3- nt Full CART | 349 | ATGGCCCTCCCTGTCACCGCCCTGCTGCTTCCGCTGGCTCTTCTGCTCCACGCCGCTCGGCCCC<br>AAGTGCAGCTCGTGGAGTCAGGCGGAGGACTGGTGCAGCCCGGGGGCTCCCTGAGACTTTCCTG<br>CGCGGCATCGGGTTTTACCTTCTCCTCCTATGCTATGTCCTGGGTGCGCCAGGCCCCGGGAAAG<br>GGACTGGAATGGGTGTCCGCAATCAGCGGTAGCGGGGGCTCAACATACTACGCCGACTCCGTCA<br>AGGGTCGCTTCACTATTTCCCGGGACAACTCCAAGAATACCCTGTACCTCCAAATGAACAGCCT<br>CAGGGCCGAGGATACTGCCGTGTACTACTGCGCCAAAGTCGGATACGATAGCTCCGGTTACTAC<br>CGGGACTACTACGGAATGGACGTGTGGGGACAGGGCACCACCGTGACCGTGTCAAGCGGCGGAG<br>GCGGTTCAGGAGGGGGAGGCTCCGGCGGTGGAGGGTCCGAAATCGTCCTGACTCAGTCGCCTGG<br>CACTCTGTCGTTGTCCCCGGGGAGCGCGCTACCCTGTCGTGTCGGGCGTCGCAGTCCGTGTCG<br>AGCTCCTACCTCGCGTGGTACCAGCAGAAGCCCGGACAGGCCCCTAGACTTCTGATCTACGGCA<br>CTTCTTCACGCGCCACCGGGATCAGCGACAGGTTCAGCGGCTCCGGCTCCGGGACCGACTTCAC<br>CCTGACCATTAGCCGGCTGGAGCCTGAAGATTTCGCCGTGTATTACTGCCAACACTACGGAAAC<br>TCGCCGCCAAAGTTCACGTTCGGACCCGGAACCAAGCTGGAAATCAAGACCACTACCCCAGCAC<br>CGAGGCCACCCACCCCGGCTCCTACCATCGCCTCCCAGCCTCTGTCCCTGCGCTCCGGAGGCATG<br>TAGACCCGCAGCTGGTGGGCCGTGCATACCCGGGGTCTTGACTTCGCCTGCGATATCTACATT<br>TGGGCCCCTCTGGCTGGTACTTGCGGGGTCCTGCTGCTTTCACTCGTGATCACTCTTTACTGTA<br>AGCGCGGTCGGAAGAAGCTGCTGTACATCTTTAAGCAACCCTTCATGAGGCCTGTGCAGACTAC<br>TCAAGAGGAGGACGGCTGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAGAACCAGCTCTACAACG<br>AACTCAATCTTGGTCGGAGAGAGGAGTACGACGTGCTGGACAAGCGGAGAGGACGGGACCCAGA<br>AATGGGCGGGAAGCCGCGCAGAAAGAATCCCAAGAGGGCCTGTACAACGAGCTCCAAAAGGAT<br>AAGATGGCAGAAGCCTATAGCGAGATTGGTATGAAAGGGGAACGCAGAAGAGGCAAAGGCCACG<br>ACGGACTGTACCAGGGACTCAGCACCGCCACCAAGGACACCTATGACGCTCTTCACATGCAGGC<br>CCTGCCGCCTCGG |
| BCMA_EBB-C1978-G4 |
| BCMA_EBB-C1978-G4- aa ScFv domain | 350 | EVQLVESGGGLVQPGGSLRLSCAASGFTFSSYAMSWVRQAPGKGLEWVSAISGSGGSTYYADSV<br>KGRFTISRDNSKNTLYLQMNSLRAEDTAVYYCAKMGWSSGYLGAFDIWGQGTTVTVSSGGGGSG<br>GGGSGGGGSEIVLTQSPGTLSLSPGERATLSCRASQSVASSFLAWYQQKPGQAPRLLIYGASGR<br>ATGIPDRFSGSGSGTDFTLTISRLEPEDFAVYYCQHYGGSPRLTFGGGTKVDIK |
| BCMA_EBB-C1978-G4- nt ScFv domain | 351 | GAAGTCCAACTGGTGGAGTCCGGGGGAGGGCTCGTGCAGCCCGGAGGCAGCCTTCGGCTGTCGT<br>GCGCCGCCTCCGGGTTCACGTTCTCATCCTACGCGATGTCGTGGGTCAGACAGGCACCAGGAAA<br>GGGACTGGAATGGGTGTCCGCCATTAGCGGCTCCGGCGGTAGCACCTACTATGCCGACTCAGTG<br>AAGGGAAGGTTCACTATCTCCCGCGACAACAGCAAGAACACCCTGTACCTCCAAATGAACTCTC<br>TGCGGGCCGAGGATACCGCGGTGTACTATTGCGCCAAGATGGGTTGGTCCAGCGGATACTTGGG<br>AGCCTTCGACATTTGGGGACAGGGCACTACTGTGACCGTGTCCTCCGGGGGTGGCGGATCGGGA<br>GGCGGCGGCTCGGGTGGAGGGGGTTCCGAAATCGTGTTGACCCAGTCACCGGGAACCCTCTCGC<br>TGTCCCCGGGAGAACGGGCTACACTGTCATGTAGAGCGTCCCAGTCCGTGGCTTCCTCGTTCCT<br>GGCCTGGTACCAGCAGAAGCCGGACAGGCACCCCGCCTGCTCATCTACGGAGCCAGCGGCCGG<br>GCGACCGGCATCCCTGACCGCTTCTCCGGTTCCGGCTCGGGCACCGACTTTACTCTGACCATTA<br>GCAGGCTTGAGCCCGAGGATTTTGCCGTGTACTACTGCCAACACTACGGGGGAGCCCTCGCCT<br>GACCTTCGGAGGCGGAACTAAGGTCGATATCAAAA |

TABLE 11-continued

Amino Acid and Nucleic Acid Sequences of the anti-BCMA scFv domains and anti-BCMA CAR molecules

| Name/ Description | SEQ ID NO: | Sequence |
|---|---|---|
| BCMA_EBB-C1978-G4- aa VH | 352 | EVQLVESGGGLVQPGGSLRLSCAASGFTFSSYAMSWVRQAPGKGLEWVSAISGSGGSTYYADSV KGRFTISRDNSKNTLYLQMNSLRAEDTAVYYCAKMGWSSGYLGAFDIWGQGTTVTVSS |
| BCMA_EBB-C1978-G4- aa VL | 353 | EIVLTQSPGTLSLSPGERATLSCRASQSVASSFLAWYQQKPGQAPRLLIYGASGRATGIPDRFS GSGSGTDFTLTISRLEPEDFAVYYCQHYGGSPRLTFGGGTKVDIK |
| BCMA_EBB-C1978-G4- aa Full CART | 354 | MALPVTALLLPLALLLHAARPEVQLVESGGGLVQPGGSLRLSCAASGFTFSSYAMSWVRQAPGK GLEWVSAISGSGGSTYYADSVKGRFTISRDNSKNTLYLQMNSLRAEDTAVYYCAKMGWSSGYLG AFDIWGQGTTVTVSSGGGGSGGGGSGGGGSEIVLTQSPGTLSLSPGERATLSCRASQSVASSFL AWYQQKPGQAPRLLIYGASGRATGIPDRFSGSGSGTDFTLTISRLEPEDFAVYYCQHYGGSPRL TFGGGTKVDIKTTTPAPRPPTPAPTIASQPLSLRPEACRPAAGGAVHTRGLDFACDIYIWAPLA GTCGVLLLSLVITLYCKRGRKKLLYIFKQPFMRPVQTTQEEDGCSCRFPEEEEGGCELRVKFSR SADAPAYKQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |
| BCMA_EBB-C1978-G4- nt Full CART | 355 | ATGGCCCTCCCTGTCACCGCCCTGCTGCTTCCGCTGGCTCTTCTGCTCCACGCCGCTCGGCCCG AAGTCCAACTGGTGGAGTCCGGGGGAGGGCTCGTGCAGCCCGGAGGCAGCCTTCGGCTGTCGTG CGCCGCCTCCGGGTTCACGTTCTCATCCTACGCGATGTCGTGGGTCAGACAGGCACCAGGAAAG GGACTGGAATGGGTGTCCGCCATTAGCGGCTCCGGCGGTAGCACCTACTATGCCGACTCAGTGA AGGGAAGGTTCACTATCTCCCGCGACAACAGCAAGAACACCCTGTACCTCCAAATGAACTCTCT GCGGGCCGAGGATACCGCGGTGTACTATTGCGCCAAGATGGGTTGGTCCAGCGGATACTTGGGA GCCTTCGACATTTGGGGACAGGGCACTACTGTGACCGTGTCCTCCGGGGGTGGCGGATCGGGAG GCGGCGGCTCGGGTGGAGGGGGTTCCGAAATCGTGTTGACCCAGTCACCGGGAACCCTCTCGCT GTCCCCGGGAGAACGGGCTACACTGTCATGTAGAGCGTCCCAGTCCGTGGCTTCCTCGTTCCTG GCCTGGTACCAGCAGAAGCCGGGACAGGCACCCGCCTGCTCATCTACGGAGCCAGCGGCCGGG CGACCGGCATCCCTGACCGCTTCTCCGGTTCCGGCTCGGGCACCGACTTTACTCTGACCATTAG CAGGCTTGAGCCCGAGGATTTTGCCGTGTACTACTGCCAACACTACGGGGGGAGCCCTCGCCTG ACCTTCGGAGGCGGAACTAAGGTCGATATCAAAACCACTACCCCAGCACCGAGGCCACCCACCC CGGCTCCTACCATCGCCTCCCAGCCTCTGTCCCTGCGTCCGGAGGCATGTAGACCCGCAGCTGG TGGGGCCGTGCATACCCGGGGTCTTGACTTCGCCTGCGATATCTACATTTGGGCCCCTCTGGCT GGTACTTGCGGGGTCCTGCTGCTTTCACTCGTGATCACTCTTTACTGTAAGCGCGGTCGGAAGA AGCTGCTGTACATCTTTAAGCAACCCTTCATGAGGCCTGTGCAGACTACTCAAGAGGAGGACGG CTGTTCATGCCGGTTCCCAGAGGAGGAGGAAGGCGGCTGCGAACTGCGCGTGAAATTCAGCCGC AGCGCAGATGCTCCAGCCTACAAGCAGGGGCAGAACCAGCTCTACAACGAACTCAATCTTGGTC GGAGAGAGGAGTACGACGTGCTGGACAAGCGGAGAGGACGGGACCCAGAAATGGGCGGGAAGCC GCGCAGAAAGAATCCCCAAGAGGGCCTGTACAACGAGCTCCAAAAGGATAAGATGGCAGAAGCC TATAGCGAGATTGGTATGAAAGGGGAACGCAGAAGAGGCAAAGGCCACGACGGACTGTACCAGG GACTCAGCACCGCCACCAAGGACACCTATGACGCTCTTCACATGCAGGCCCTGCCGCCTCGG |

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Example 1: Optimizing CART Production with Exogenous Cytokines

Cytokines have important functions related to T cell expansion, differentiation, survival and homeostasis. One of the most important cytokine families for clinical use is the common γ-chain ($γ_c$) family cytokines, which includes interleukin (IL)-2, IL-4, IL-7, IL-9, IL-15 and IL-21 (Liao et al., 2013, *Immunity*, 38:13-25. IL-2 has been widely studied as an immunotherapeutic agent for cancer. The supplement of IL-2 enhanced the antitumor ability of anti-CD19 CAR-T cells in the clinical trials (Xu et al., 2013, *Lymphoma*, 54:255-60). However, the administration of IL-2 is limited by side effects and a propensity for expansion of regulatory T cells and the effect of activated induced cell death (AICD) (Malek et al., 2010, *Immunity*, 33:153-65; and Lenardo et al., 1999, *Annu Rev Immunol*, 17:221-53). IL-7, IL-15, and IL-21 each can enhance the effectiveness of adoptive immunotherapies and seems to be less toxicity compared with IL-2 (Alves et al., 2007, *Immunol Lett*, 108:113-20). Despite extensive preclinical and clinical studies on the role of the above cytokines, multi-parameter comparative studies on the roles of various exogenous $γ_c$ cytokines on CAR-T cell adoptive therapy are lacking.

Besides γ-chain cytokines, IL-18 is another immunostimulatory cytokine regulating immune responses, which enhances the production of IFN-γ by T cells and augments the cytolytic activity of CTLs (Srivastava et al., 2010, *Curr Med Chem*, 17:3353-7). Administration of IL-18 is safe and well tolerated, even when the dose reaching as high as 1000 μg/kg (Robertson et al., 2006, *Clin Cancer Res*, 12:4265-73). Therefore, IL-18 could be another candidate used to boost the antitumor of CAR-T cells.

In this example, the effect of administration of different exogenous cytokines was examined for expansion, phenotype, in vitro effector functions, and in vivo anti-tumor efficacy of T cells and folate receptor alpha (FRα) CART cells.

The following materials and methods were used in the experiments described in this example.

CAR Construction and Lentivirus Preparation

The pELNS-C4-27z CAR vector was constructed as described previously (manuscript under review), Briefly, the pHEN2 plasmid containing the anti-FRα C4/AFRA4 scFv was used as a template for PCR amplification of C4 fragment using the primers of 5'-ataggatcccagctggtggagtctgggg-gaggc-3' (SEQ ID NO: 3) and 5'-atagctagcacctaggacggtcagcttggtccc-3' (SEQ ID NO: 4) (BamHI and NheI were underlined). The PCR product and the third generation self-inactivating lentiviral expression vectors pELNS were digested with BamHI and NheI. The digested PCR products were then inserted into the pELNS vector containing CD27-CD3z T-cell signaling domain in which transgene expression is driven by the elongation factor-1α (EF-1α) promoter.

High-titer replication-defective lentivirus was generated by transfection of human embryonic kidney cell line 293T (293T) cells with four plasmids (pVSV-G, pRSV.REV, pMDLg/p.RRE and pELNS-C4-27z CAR) by using Express In (Open Biosystems) as described previously. Supernatants were collected at 24 h and 48 h after transfection and concentrated by ultracentrifugation. The virus titers were determined based on the transduction efficiency of lentivirus to SupT1 cells by using limiting dilution method.

T Cells and Cell Lines

Peripheral blood lymphocytes were obtained from healthy donors after informed consent under a protocol approved by University Institutional Review Board at the University of Pennsylvania. The primary T cells were purchased from the Human Immunology Core after purified by negative selection. T cells were cultured in complete media (RPMI 1640 supplemented with 10% FBS, 100 U/mL penicillin, 100 µg/mL streptomycin sulfate) and stimulated with anti-CD3 and anti-CD28 mAbs-coated beads (Invitrogen) at a ratio of 1:1 following the instruction. Twenty-four hours after activation, cells were transduced with lentivirus at MOI of 5. Indicated cytokines were added to the transduced T cells from the next day with a final concentration of 10 ng/mL. The cytokines were replaced every 3 days.

The 293T cell used for lentivirus packaging and the SupT1 cell used for lentiviral titration were obtained from ATCC. The established ovarian cancer cell lines SKOV3 (FRα+) and C30 (FRα−) was used as target cell for cytokine-secreting and cytotoxicity assay. For bioluminescence assays, SKOV3 was transduced with lentivirus to express firefly luciferase (fLuc).

Flow Cytometric Analysis and Cell Sorting

Flow cytometry was performed on a BD FACSCanto. Anti-human CD45 (HI30), CD3 (HIT3a), CD8 (HIT8a), CD45RA (HI100), CD62L (DREG-56), CCR7 (G043H7), IL-7Rα (A019D5), CD27 (M-T271), CD28 (CD28.2), CD95 (DX2), TNF-α (MAb11), IFN-γ (4S.B3), IL-2 (MQ1-17H12), perforin (B-D48), granzym-B (GB11) were obtained from Biolegend. Biotin-SP-conjugated rabbit anti-human IgG (H+L) was purchased from Jackson Immunoresearch and APC conjugated streptavidin was purchased from Biolegand. Anti-human Bcl-xl (7B2.5) was purchased from SouhernBiotech. Apoptosis kit and TruCount tubes were obtained from BD Bioscience. For peripheral blood T cell count, blood was obtained via retro-orbital bleeding and stained for the presence of human CD45, CD3, CD4 and CD8 T cells. Human CD45+-gated, CD3+, CD4+ and CD8+ subsets were quantified with the TruCount tubes following the manufacturer's instructions.

In Vivo Study of Adoptive Cell Therapy

Female non-obese diabetic/severe combined immunodeficiency/γ-chain$^{-/-}$ (NSG) mice 8 to 12 weeks of age were obtained from the Stem Cell and Xenograft Core of the Abramson Cancer Center, University of Pennsylvania. The mice were inoculated subcutaneously with $3 \times 10^6$ fLuc$^+$ SKOV3 cells on the flank on day 0. Four or Five mice were randomized per group before treatment. After tumors became palpable, human primary T cells were activated and transduced as described previously. T cells were expanded in the presence of IL-2 (5 ng/mL) for about 2 weeks. When the tumor burden was ~250-300 mm$^3$, the mice were injected with $5 \times 10^6$ CAR-T cells or 100 µl saline intravenously and then received daily intraperitoneal injection of 5 µg of IL-2, IL-7, IL-15, IL-18, IL-21 or phosphate buffer solution (PBS) for 7 days. Tumor dimensions were measured with calipers and tumor volumes were calculated with the following formula: tumor volume=(length×width$^2$)/2. The number and phenotype of transferred T cells in recipient mouse blood was determined by flow cytometry after retro-orbital bleeding. The mice were euthanized when the tumor volumes were more than 2000 mm$^3$ and tumors were resected immediately for further analysis.

Statistical Analysis

Statistical analysis was performed with Prism 5 (GraphPad software) and IBM SPSS Statistics 20.0 software. The data were shown as mean±SEM unless clarified. Paired sample t-tests or nonparametric Wilcoxon rank tests were used for comparison of two groups and repeated measures ANOVA or Friedman test were used to test statistical significance of differences among three or more groups. Findings were considered as statistically significant when P-values were less than 0.05.

Results

1. Construction and Expression of Anti-FRα C4 CAR

The pELNS-C4-27z CAR comprised of the anti-FRα C4 scFv linked to a CD8α hinge and transmembrane region, followed by a CD3ζ signaling moiety in tandem with the CD27 intracellular signaling motif (FIG. 1A). Primary human T cells were efficiently transduced with C4 CAR lentiviral vectors with transduction efficiencies of 43%-65% when detected at 48 h after transduction. CAR expression levels were comparable between CD4+ and CD8+ T cells (52.6±10.2% vs. 49.5±17.1%, P=0.713).

2. Influence of Cytokines on Expansion of CAR Transduced T (CAR-T) Cell

Figure 1B:
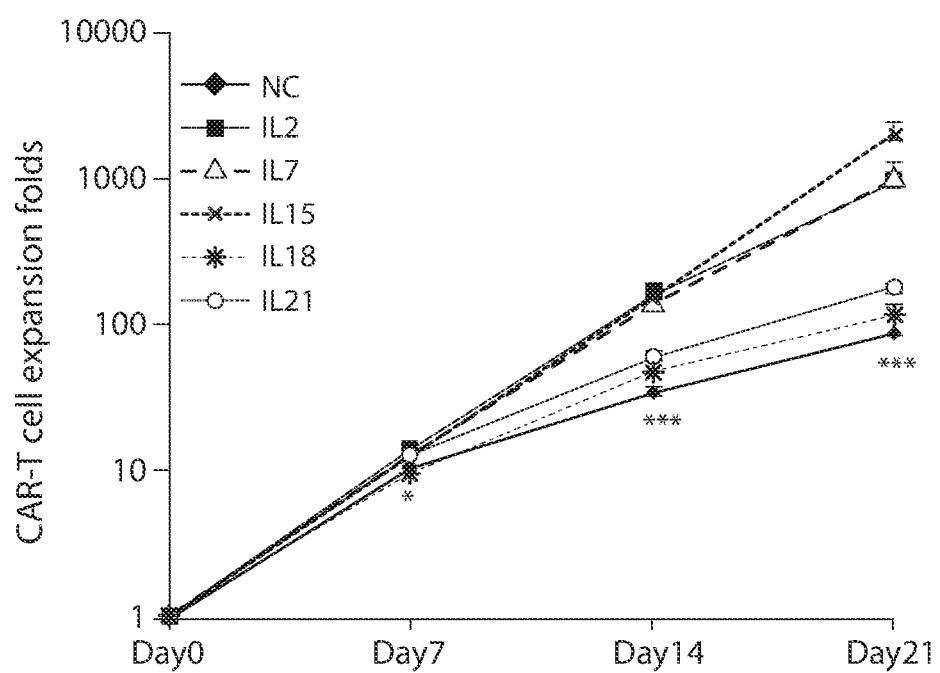

The expansion and accumulation of CAR-T cells in the presence of various γc cytokines and IL-18 was investigated. Three weeks after exposure to the different cytokines in culture, CAR-T cells that had been cultured in the presence of IL2, IL-7 or IL-5 had expanded 1000-2000 fold. CAR-T cells that had been cultured in the presence of IL-18, IL-21 or NC (control, no cytokine) demonstrated a less than 200 fold expansion (FIG. 1B).

Figure 1C:
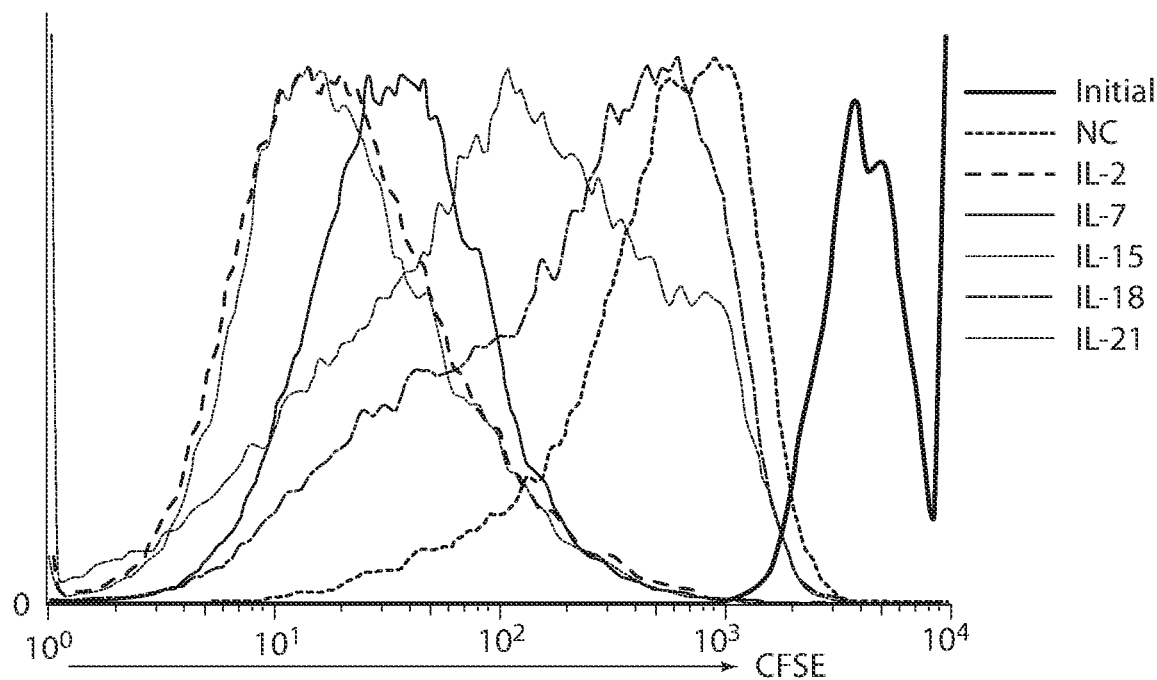
Figure 1D:
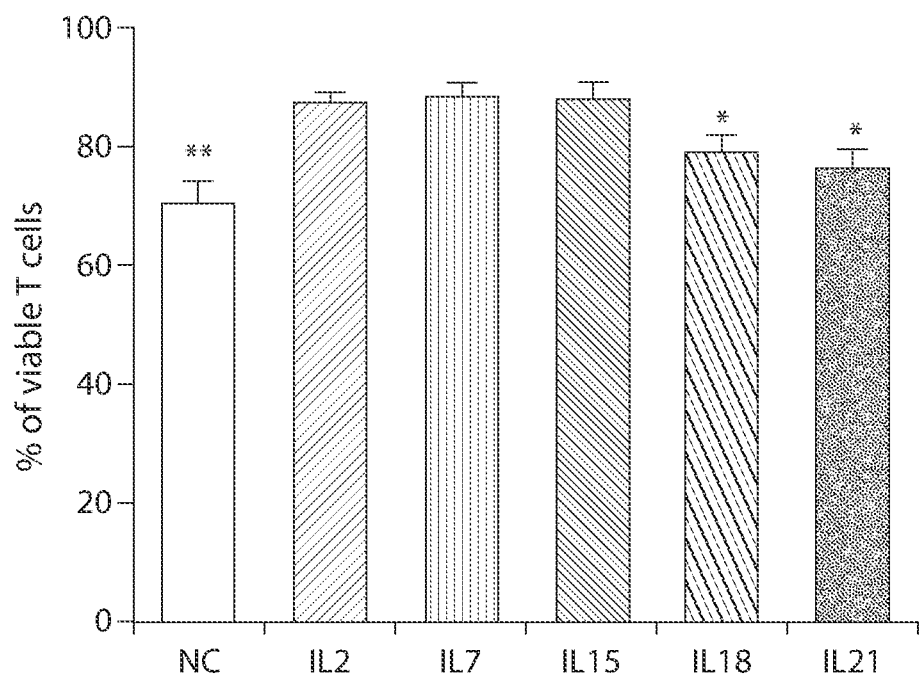

The reasons contributing to the higher accumulation of CAR-T cells were analyzed, specifically, proliferation and apoptosis of the T cells was assessed. The proliferative response was measured by monitoring cell division of CFSE labeled T cells cultured for 7 days. As shown in FIG. 1C, T cells cultured with IL-2 and IL-15 showed the highest proliferative ability, followed by IL-7; while IL-21 and IL-18 were less potent mitogenic stimulants. Apoptosis of the T cells cultured in the different cytokines was tested using Annexin-V staining. The results indicated that T cells cultured in IL-2, IL-7 and IL-15 underwent less apoptosis when compared with NC, IL-18 and IL-21 groups (FIG. 1D). These results indicate that increased accumulation of T cells expanded in the presence of cytokines, e.g., IL-2, IL-7, or IL-15, may be caused by both an increase in proliferation and a decrease in apoptosis, e.g., by activation of the Bcl-xl anti-apoptotic pathway.

3. Influence of Cytokines on the Phenotypes of CAR-T Cells

Figure 2A:
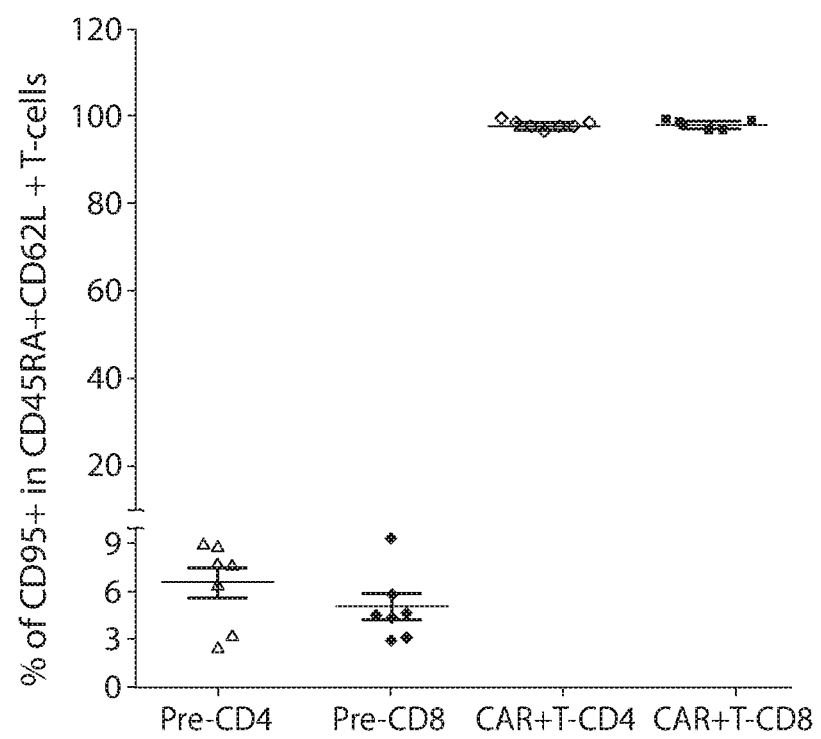
FIGS. 2A-2F shows the memory T cell subsets of CAR-T cells.
Figure 2B:
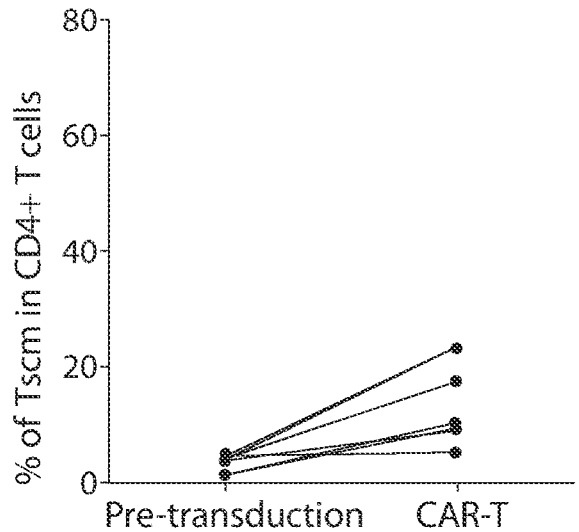
Figure 2C:
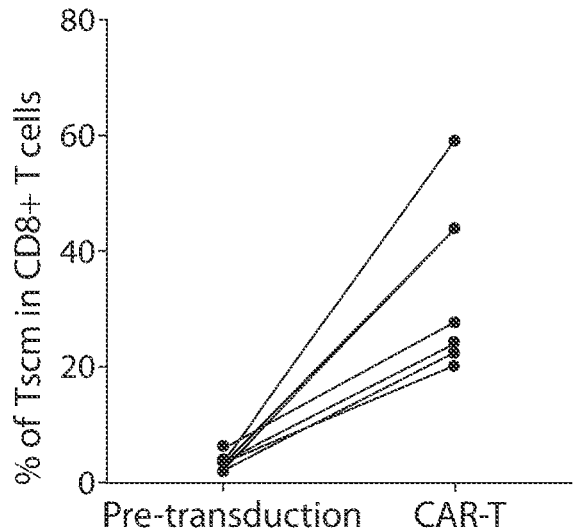
Figure 2D:
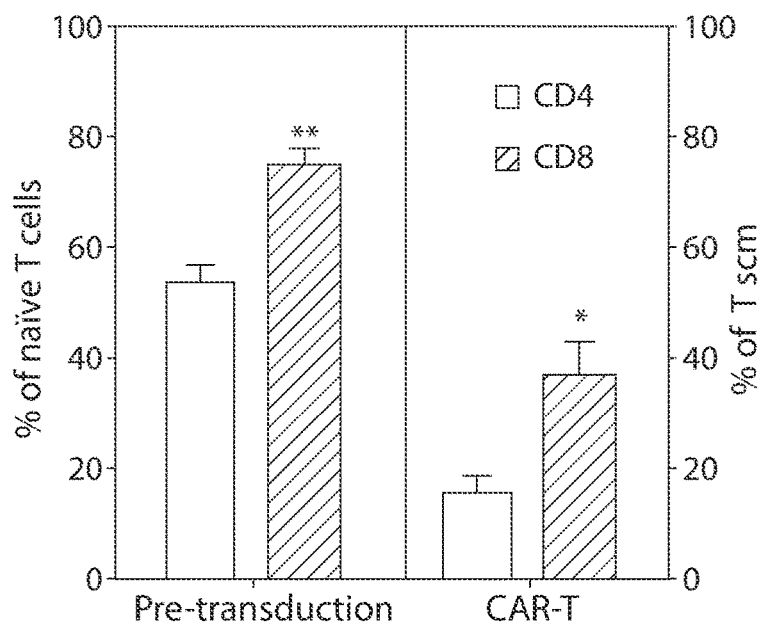

Next, the phenotype of the CAR-T cells expanded in the presence of exogenous cytokines was examined. The fresh T cells from healthy donors were generally divided into four subsets based on CD45RA and CD62L expression: 1) naïve T cell (CD45RA+CD62L+, referred to as Tn), 2) central memory T cell (CD45RA-CD62L+, referred to as Tcm), 3) effector memory T cell (CD45RA-CD62L-, referred to as Tem) and 4) CD45RA positive effector T cell (CD45RA+CD62L-, referred to as Temra). Then the expression of CCR7, CD27, CD28, and CD95 are further evaluated for each subset. The CD95 expression was significantly upregulated upon lentiviral transduction. The latter three T cell subsets were positive for CD95 while only small part of Tn expressed CD95 (3.6±1.4% in CD4+ and 3.7±1.3% in CD8+ T cells). This small population also co-expressed CD27, CD28 and CCR7, and was considered as memory stem T cells (Tscm). However, after stimulation with anti-CD3/CD28 beads before and after lentiviral transduction with CAR, CD95 was greatly up-regulated to nearly 100% in this population (FIG. 2A). The percentages of CD45RA+CD62L+CD95+ T cells were greatly expanded after anti-CD3/CD28 bead stimulation in both CD4+ and CD8+ T and CAR-T cells when compared with the fresh T cells (FIGS. 2B and 2C). This population highly expressed CD27, CD28 and CCR7 simultaneously, indicating it could be defined as Tscm. Furthermore, CD8+ CAR-T cells had a higher percentage of Tscm cells, which may be related to the higher proportion of Tn in initial CD8+ T cells (FIG. 2D).

Fourteen days after co-culture with various cytokines, the proportion of T cell subsets of CAR-T cells were investigated by measuring the expression of CD45RA, CD62L and CD95. Of the CD4+ CAR-T cells, a significantly higher percentage of Tscm cells existed in the IL-7 group compared with the IL-2 group, while the no cytokine (NC) and IL-18 groups presented lower percentages of Tscm but higher percentages of Tcm. The distribution of T cell subsets in the IL-15 group was similar with the IL-2 group, while the IL-21 group presented a higher percentage of Tcm, while percentage of Tscm was comparable with the IL-2 group. The CD8+ CAR-T cells demonstrated a similar trend as that of the CD4+ CAR-T cells on the differentiation and distribution of the four T cell subsets for each cytokine-administered group, with higher proportions of Tscm compared with CD4+ CAR-T cells in the corresponding group of CD8+ CAR-T cells.

Figure 2E:
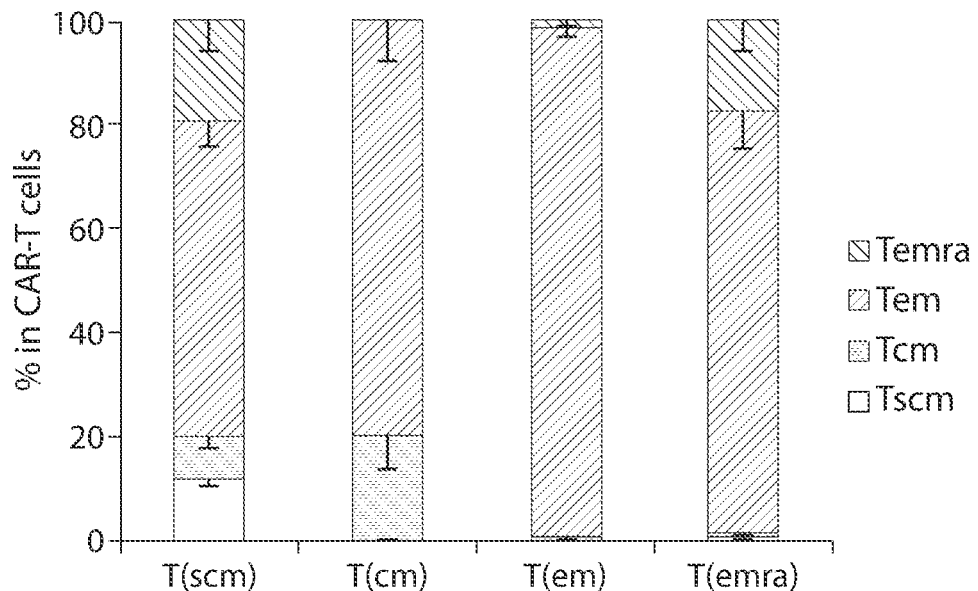
Figure 2F:
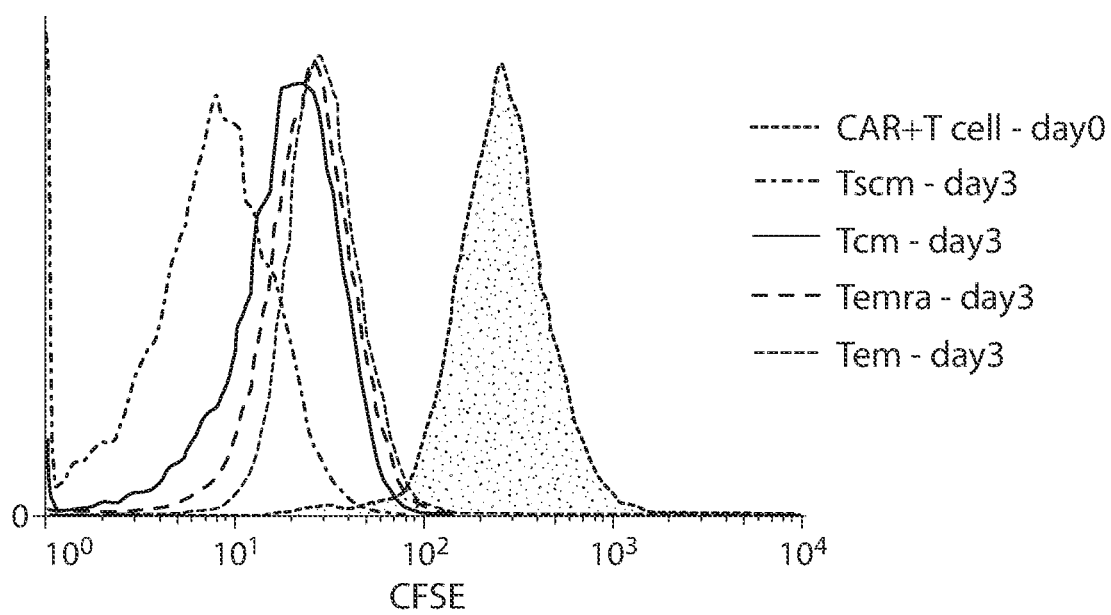
Figure 3A:
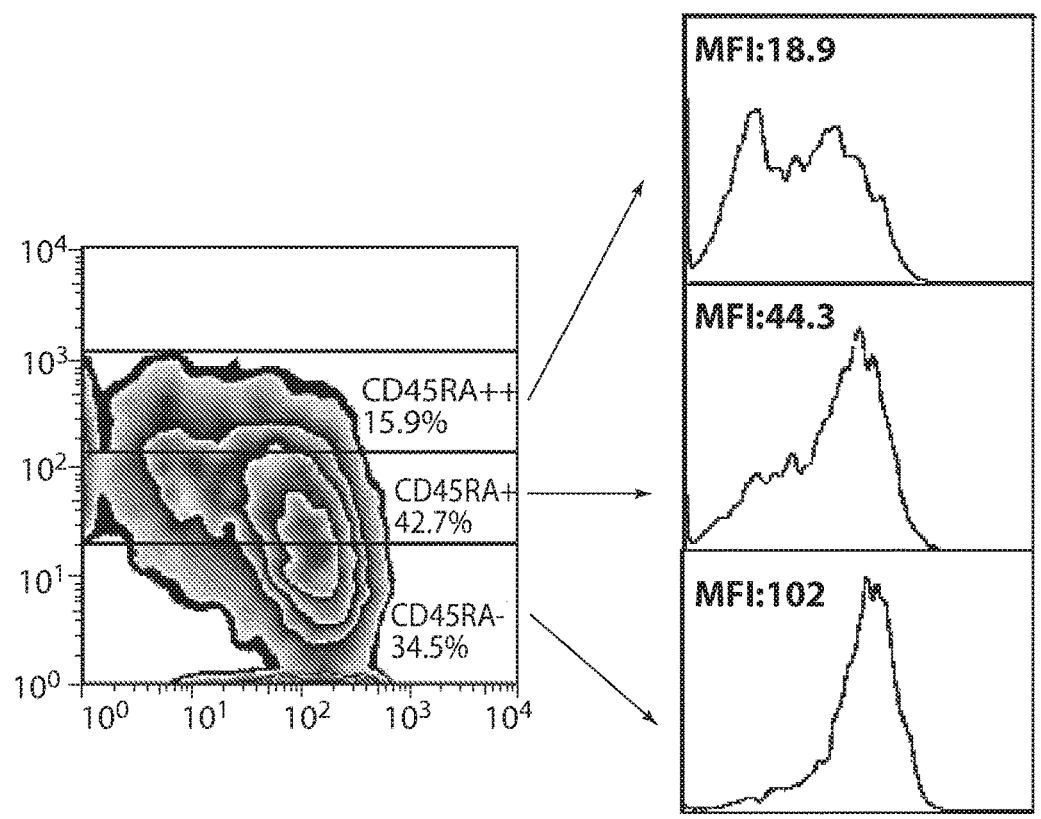
FIG. 3A-3B show the correlation between CD45 RA expression and CFSE intensity.
Figure 3B:
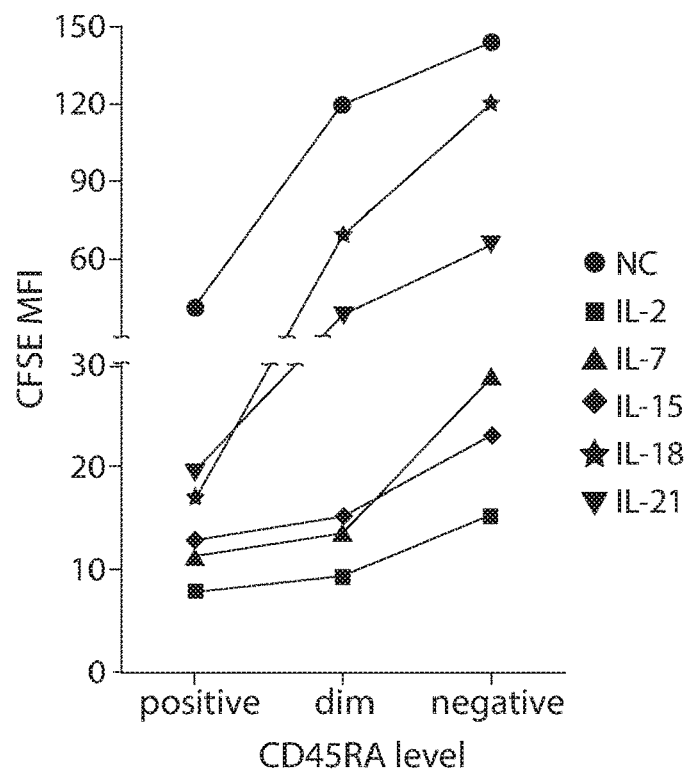
Figure 4:
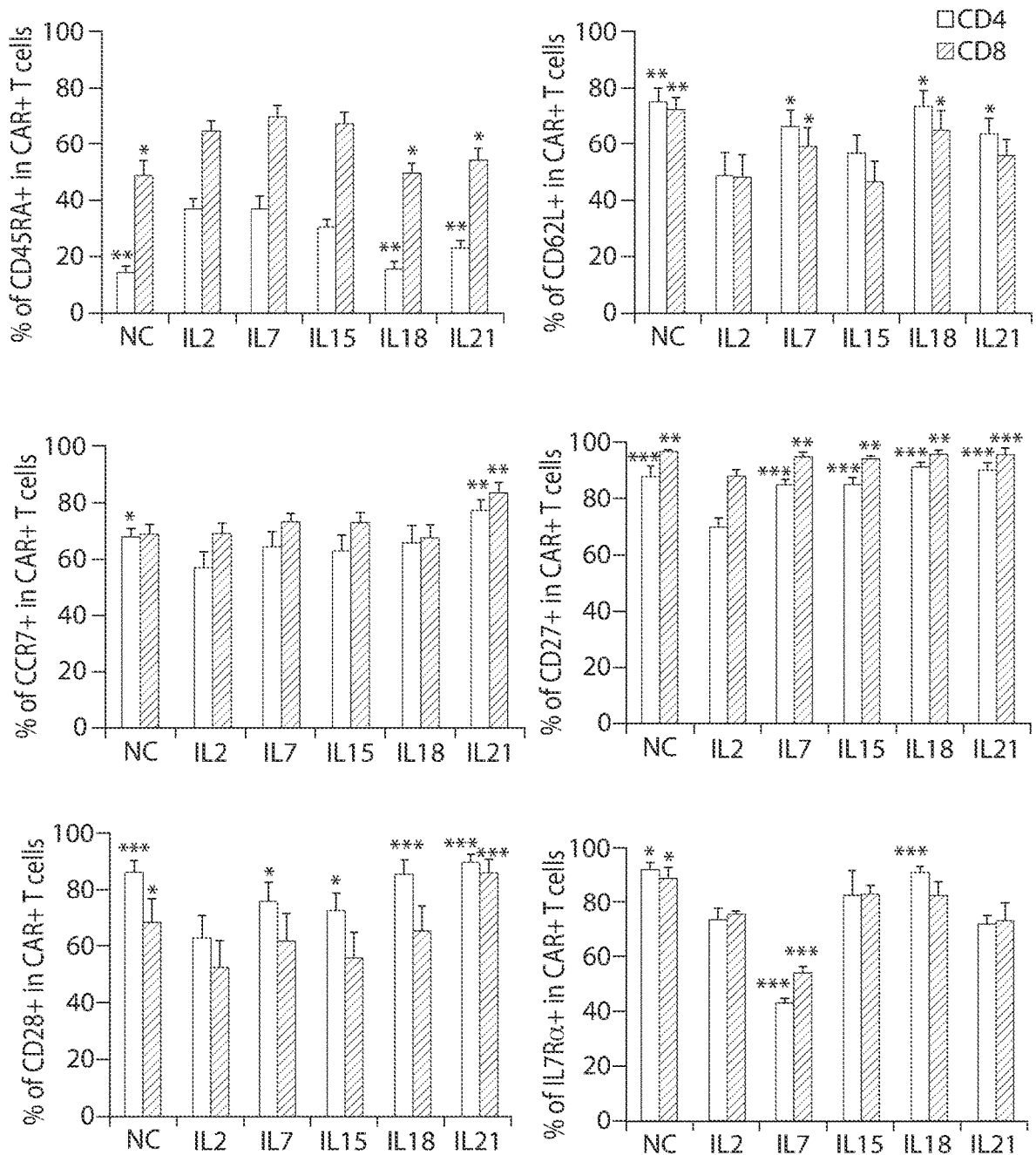
FIG. 4 shows the phenotypes of CAR-T cells resulting from exposure to different cytokines.

The abilities of various CAR-T cell subpopulations to self-renew and to differentiate into other cell types were further studied. The four subsets of CAR-T cells were sorted based on CAR, CD45RA and CD62L expression and cultured separately in medium containing IL-2 for 3 days. As shown in FIG. 2E, the Tscm subset was able to differentiate into all the other three subsets, and Tcm and Temra subsets were able to differentiate into Tem. These results indicate that CD62L+ and CD45RA+ T cells were able to differentiate into CD62L- and CD45RA- T cells, respectively. The proliferation capacity of the four subsets was assessed by CFSE dilution and then compared. The results showed the Tscm presented stronger proliferation ability than other subsets (FIG. 2F). Furthermore, CD45RA expression inversely correlated with CFSE intensity while CD62L and CCR7 expression directly correlated with proliferation. In all cytokine groups, CD45RA+ T cells exhibited much lower CFSE levels than CD45RA dim and negative T cells (FIG. 3A-3B), indicating that CD45RA+ T cells had stronger proliferation activity than CD45RA- T cells. Thus, the increased accumulation of T cells grown in the presence of IL-2, IL-7 and IL-15 may be related to the increased proportion of CD45RA+ T cells (which have increased proliferation capacity) (FIG. 4).

With regard to the phenotype of the CAR-T cells, CAR-T cells presented lower expression of CD45RA, CD62L, CD27 and CD28, but higher expression of CCR7 on the surface of T cells. The influence of cytokines on the phenotype of CAR-T cells were further assessed based on the expression of the following surface markers: CD27, CD28, CD62L, CCR7 and IL7Ra. CAR-T cells grow in the presence of IL-18 showed quite similar expression pattern with those grown without cytokine supplement. IL-2 dramatically down-regulated the expressions of CD27, CD28 CD62L, CCR7 and ILR7a when compared with NC control. Of the other γc cytokines, compared with IL-2 exposed CAR-T cells, IL-7 exposed CAR-T cells presented higher CD62L, CD27 and CD28 expression but significantly decreased CCR7 expression; IL-15 group CAR-T cells presented higher CD27 and CD28 expression; and IL-21 exposed CAR-T cells presented higher CD62L, CCR7, CD27 and CD28 expression, indicating that IL-2 exposure induced the expansion of a subset of T cells with a much more mature T cell phenotype than all other groups (FIG. 4).

4. Influence of Cytokines on the Effector Function of CAR-T Cells

Figure 5A:
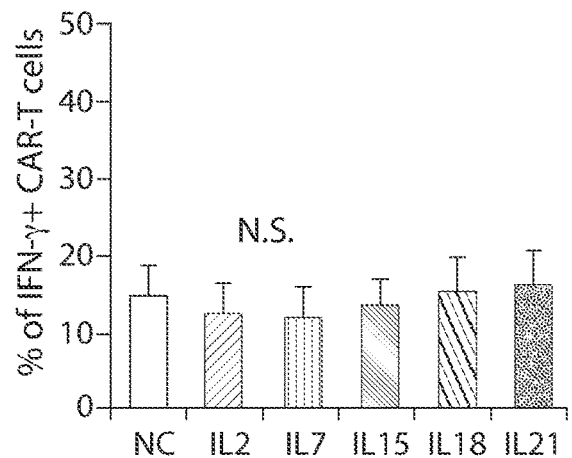
FIGS. 5A-5D show the functional analysis of CAR-T cells exposed to different cytokines.
Figure 5B:
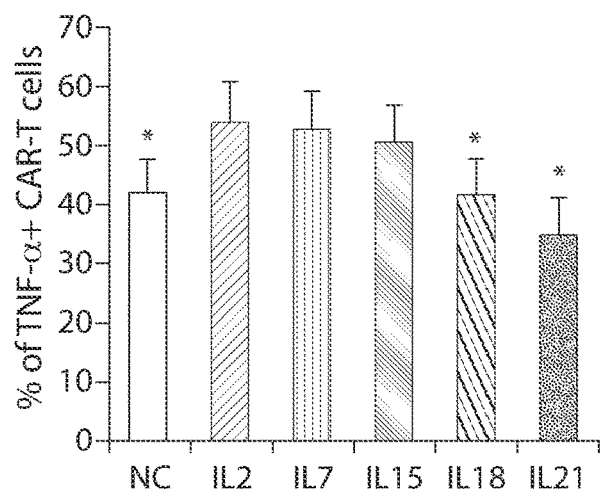
Figure 5C:
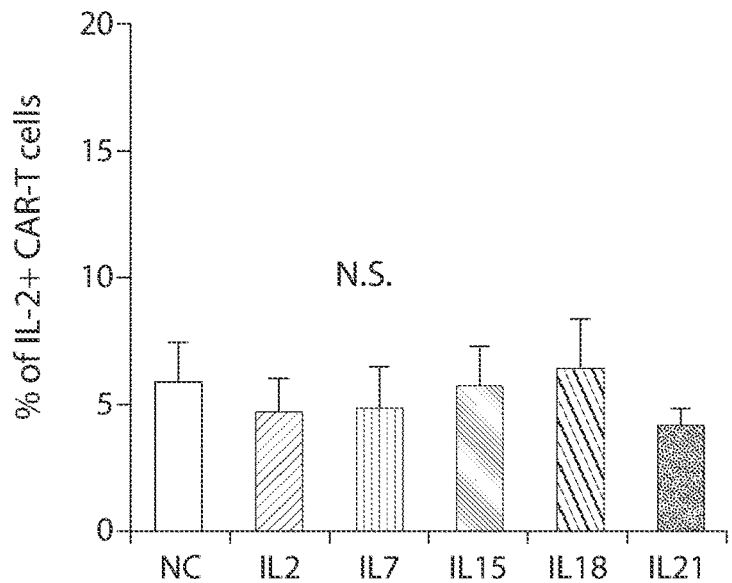

To investigate the influence of cytokines on CAR-T cell effector function, the cytokine production capability of CAR-T cells after stimulation with FRa-expressing SKOV3 cells was assessed. Following 5 hours stimulation, TNF-α, IFN-γ and IL-2 were detectable in the cytoplasm of CAR-T cells, with 41.5-54.0% of the CAR-T cells produced TNF-α, 12.4-15.3% of the CAR-T cells produced IFNγ, and 4.3-6.5% of CAR-T cells produced and IL-2 (FIGS. 5A-5C). IL-2, IL-7 and IL-15 exposure during expansion promoted CAR-T cells to produce TNF-α, while the numbers of IFN-γ and IL-2 producing CAR-T cells were comparable among all the cytokine groups (FIGS. 5A, 5B, and 5C). Next, the fractions of responding CAR-T cells and their polyfunctionality were compared. In comparison to exposure to IL-2 during expansion, exposure to IL-18, IL-21 or no cytokine exposure during expansion induced less cytokine-producing CAR-T cells, and less CAR-T cells possessed the ability to produce multiple cytokines when stimulated by target cells. These results are consistent with the phenotype that the CAR-T cells in IL-18, IL-21 and NC groups were less differentiated than those in the IL-2 exposed group.

Then, the effect of cytokine exposure during expansion on the expression of the cytolytic molecules perforin and granzyme-B after antigen stimulation was determined. Similar with TNF-α production, the CAR-T cells exposed to IL-2, IL-7, and IL-15 demonstrated increased perforin expression compared with CAR-T cells exposed to NC, IL-18 and IL-21. However, although CAR-T cells exposed to IL-21 produce less TNF-α and perforin, they produced the highest level of granzyme-B. The next highest levels of granzyme-B production were observed in CAR-T cells exposed to IL-2 and IL-15 during expansion. CAR-T cells in IL-18 group presented the least amount of both perforin and granzyme-B expression after antigen stimulation.

Figure 5D:
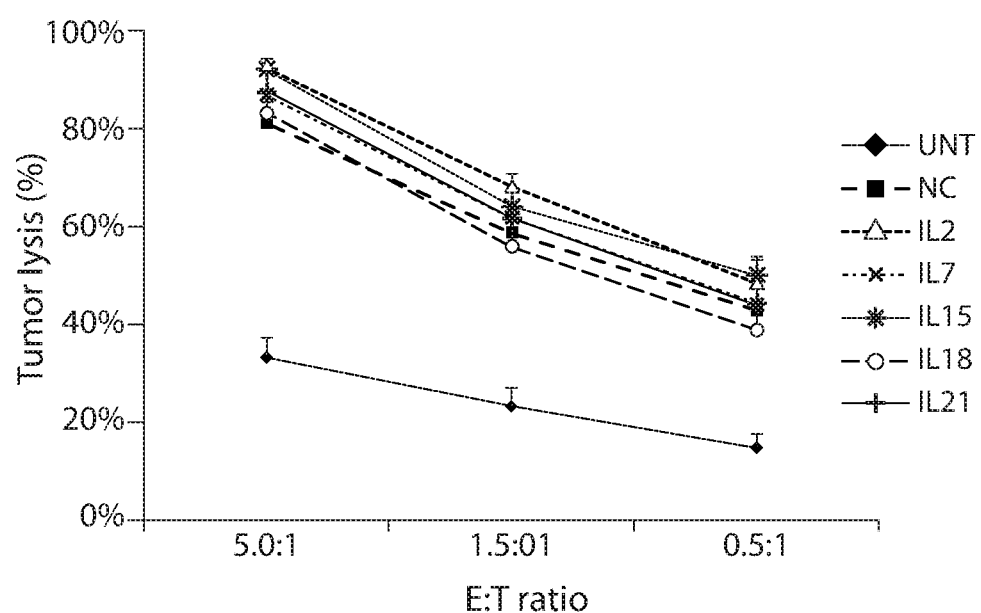

Finally, the tumor lysis activity by CAR-T cells exposed to various cytokines during exposure was quantified by luciferase assay. As shown in FIG. 5D, CAR-T cells co-cultured with IL-2 and IL-15 lysed the SKOV3 more efficiently than those with NC and IL-18 (both $P<0.05$).

The association between phenotype of the CAR-T cells and their function was further confirmed. The T cells 14 days were sorted after lentiviral transduction based on CAR and CD62L expression. The CD62L+ CAR-T cells (Tscm and Tcm) exhibited less cytokine production activity and weaker cytolytic capacity when compared with CD62L− CAR-T cells (Tem and Temra) (FIGS. 6A-6C). In this perspective, CAR-T cells exposed to IL-2 and IL-15 produced more cytokines and presented stronger tumor lysis activity, which might be partially attributed to the higher proportions of Tem and Temra in these groups.

5. Expansion and Phenotype of CAR-T Cells after Antigen Challenge

Figure 7A:
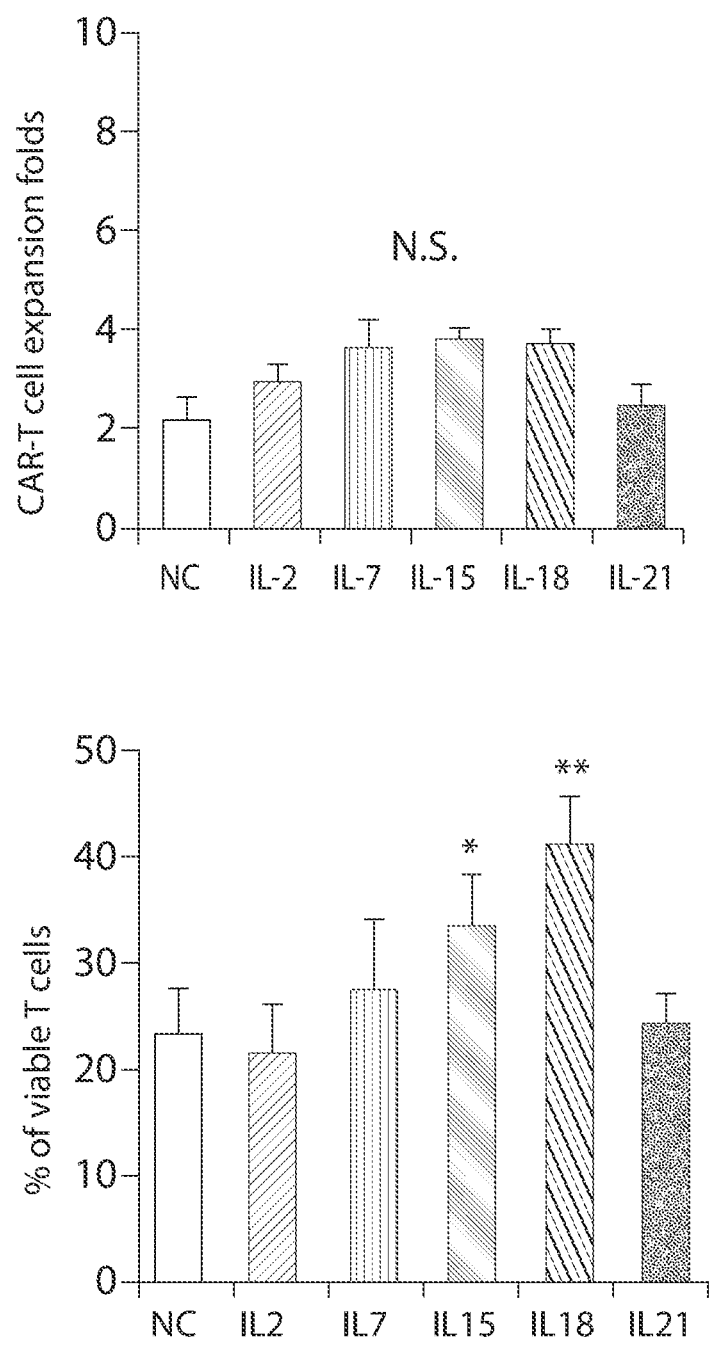
FIGS. 7A-7B show the expansion and phenotype of CAR-T cells exposed to antigen challenge.
Figure 7B:
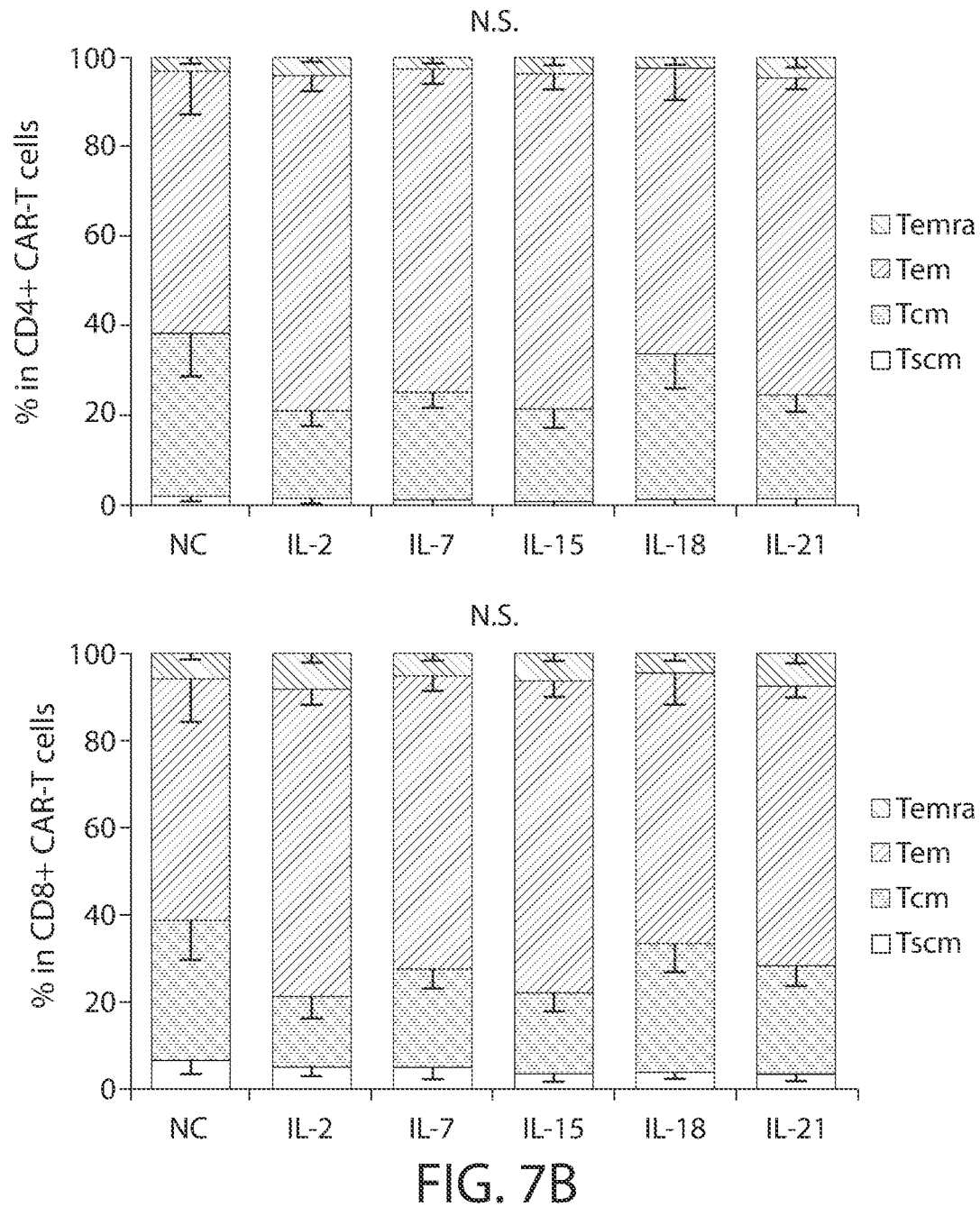

To investigate the influence of cytokines on CAR-T cell expansion under the challenge of specific antigen, the CAR-T cells exposed to IL-2 for two weeks were co-cultured with SKOV3 (FRα+) or C30 (FRα−) cells in the presence of indicated cytokines for 7 days. Similar to the antigen-free circumstance, CAR-T cells exposed to IL-2, IL-7 and IL-15 presented higher fold expansion than CAR-T cells exposed to other cytokines. The CAR-T cells exposed to IL-21 during expansion were more likely to undergo apoptosis. However, when the CAR-T cells exposed to the indicated cytokines for two weeks were co-cultured with SKOV3 or C30 cells without further cytokine supplement for 7 days, the accumulation of CAR-T cells were comparable among all groups, with those having been exposed to IL-15 and IL-18 undergoing the least amount of apoptosis (FIG. 7A). The phenotypes of CAR-T cells were also analyzed. As to the four subsets of memory T cells, the results were different from antigen-free study: Tscm was rare and Tem accounted for more than 50% in no cytokine, IL-18 and IL-21 all groups. Cytokines had no significant impact on the composition of memory T subsets and IL-7 exposure did not favor the increase of Tscm (FIG. 7B).

6. Anti-Tumor Efficacy of Various Cytokines in Animal Models

Figure 8A:
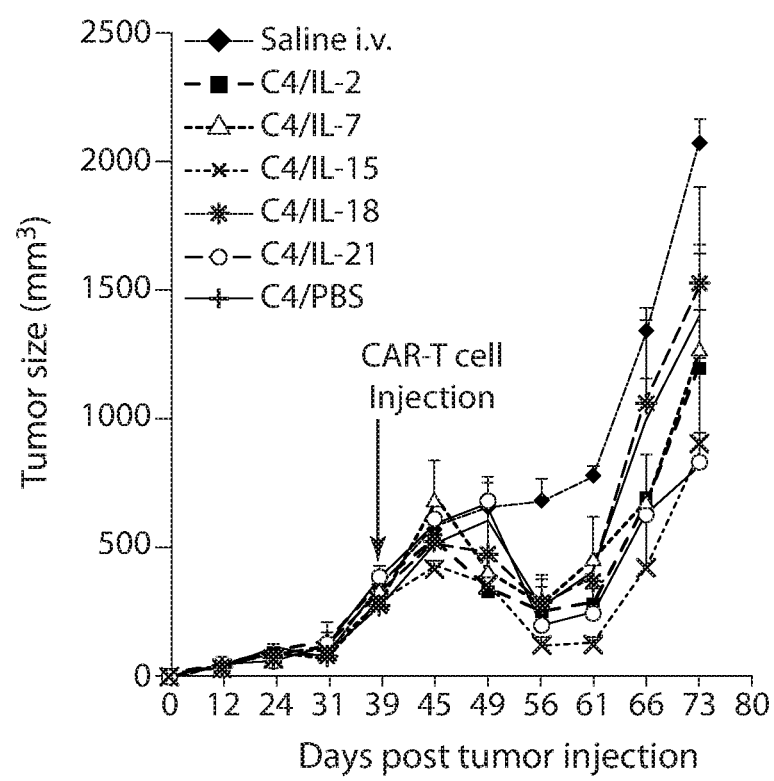
FIGS. 8A-8C show the antitumor activity of various CAR-T cells with previous cytokine exposure.
Figure 8B:
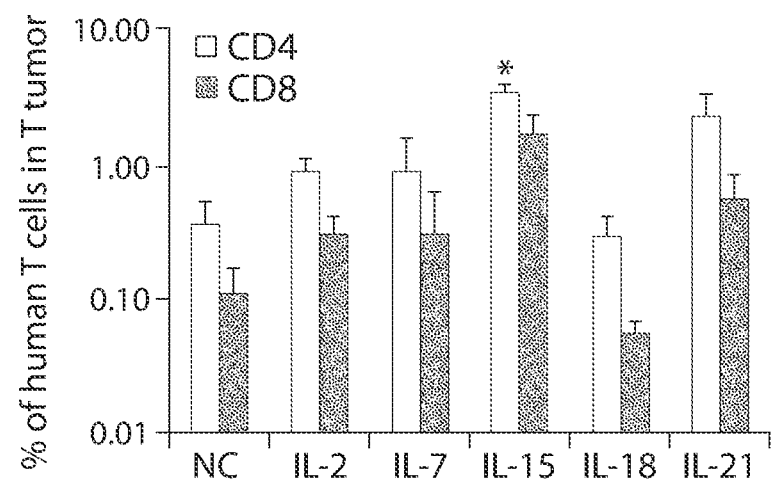
Figure 8C:
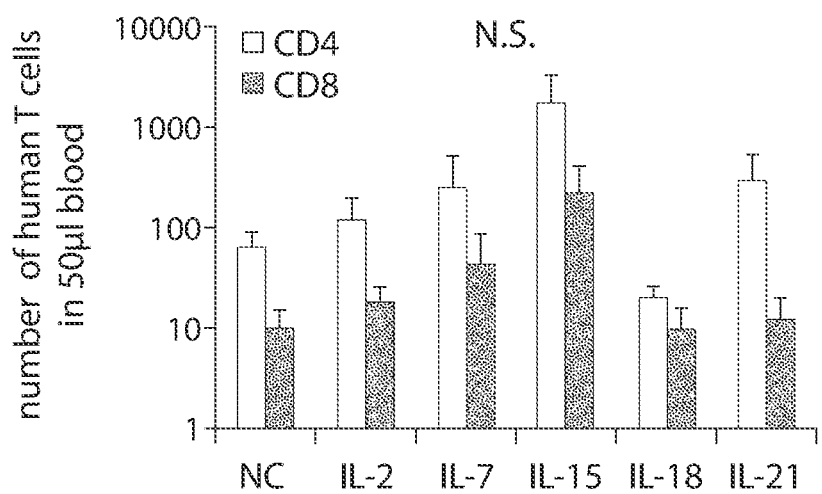

To evaluate the effects of various cytokines during ex vivo expansion of CAR-T cells on the efficacy of CAR-T cells in vivo, the persistence of CAR-T cells and outcome was investigated by using a NSG mouse xenograft model of ovarian cancer. Mice bearing subcutaneous SKOV3 tumors were intravenously injected with two doses of $5 \times 10^6$ C4-27z CAR-T cells which had been exposed to the indicated cytokines ex vivo for 2 weeks previously. All mice receiving C4-27z CAR-T cell infusion presented less tumor burden when compared with those injected with untransduced T cells and anti-CD19 CAR-T cells (FIG. 8A). Of the various cytokine groups, mice receiving CAR-T cells with previous IL-2 exposure showed the highest tumor burden, consistent with the least amount of circulating human T cell in these mice. The tumors in NC, IL-7, IL-15, IL-18 and IL-21 groups were all significantly suppressed or even disappeared, without any statistical difference on tumor size. The persistence of transferred T cells in the peripheral blood was determined 15 and 32 days after adoptive transfer. Mice receiving IL-7 and IL-21 treated CAR-T cells seemed to have higher amount of human T cells than other groups in the peripheral blood on day +15, while mice receiving IL-2 treated CAR-T cells had the lowest number of human T cells (FIGS. 8B-8C). As to the percentages of different CAR-T cell populations, NC, IL-15, IL-18 and IL-21 exposed groups all presented higher CD4+ CAR-T cells when compared with IL-2 group, while the percentages of CD8+ CAR-T cells were comparable among all the groups. Of the T cell phenotypes, CD62L, CD27 and CD28 were expressed only on about 5-10% of T cells and were comparable among all groups, except that CD8+ T cells in IL-21 group expressed higher CD28 than those in IL-2 and NC group (both $P<0.05$). On day +32, the circulating human T cells in all CAR-T cell groups expanded significantly except the IL-2 group, with an average T cell account of 14907/μl to 19651/μl (and only 242/μl in the IL-2 group). Two mice died although the tumors were regressed.

Discussion

IL-2 is the most frequently used cytokine for generating lymphocytes for adoptive immunotherapy. It promotes T cell survival and expansion, enhances tumor-killing ability of T cells. However, the action of IL-2 is limited as it results in activation induced cell death (AICD) of T-cell and the development of regulatory T-cell (Malek et al., *Immunity*, 2010, 33:153-65; and Lenardo et al., *Annu Rev Immunol*, 1999, 17:221-53). In this example, IL-2 significantly increased the accumulation of CAR-T cells and their cytotoxicity ability, but IL-2 exposed CAR-T cells presented inferior antitumor immunity in vivo following adoptive transfer. This finding demonstrates an inverse relationship between in vitro tumor-lysis and in vivo tumor eradication. IL-2 exposed CAR-T cells displayed a relative mature phenotype with low expression of CD62L, CCR7, CD27 and CD28, which are less persistent in vivo (Yang et al., *Cancer Immunol Immunother*, 2013, 62:727-36). Recent studies have indicated that adoptive transfer of less differentiated T cells correlates with superior tumor regression, which supports the finding that IL-2 exposed CAR-T cells are less effective than other group (Gattinoni et al., *Nat Med*, 2011, 17:1290-7; and Markley et al., *Blood*, 2010, 115:3508-19).

IL-15 presented similar performance of stimulating CAR-T cell expansion and tumor-lysis function as IL-2, but induced a less differentiated phenotype (higher expression of CD27 and CD28). Therefore, IL-15 supports the persistence of CAR-T cells in vivo and shows better antitumor immunity in animal models.

Compared with IL-2 and IL-15, IL-7 showed similar capability to promote CAR-T cell expansion, but induced higher level of CD62L expression and exhibited the highest proportion of CAR-Tscm cells in an antigen-free circumstance. Therefore, compared to CAR-T cells exposed to IL-2, ex vivo exposure of IL-7 without antigen challenge enhanced the antitumor efficacy of the CAR-T cells. IL-7 exposed CAR-T cells did not result in better in vivo antitumor efficacy than IL-2, and efficacy was inferior to IL-15 due to the less expansion of CAR-T cells under antigen challenge.

IL-21 exerted few effects on CAR-T cell accumulation as it could not enhance anti-apoptosis ability, e.g., by promoting Bcl-xL expression. However, IL-21 induced the expansion of less differentiated CAR-T cells, with a phenotype of high expression of CD62L, CCR7, CD27 and CD28, even under the circumstance of antigen challenge. Therefore, IL-21 exposed CAR-T cells showed best persistence in animal models and IL-21 injection in vivo, and also presented a better efficacy in promoting tumor eradication than other cytokine groups except IL-15. These results are consistent with previous finding that less differentiated CAR-T cells correlates with superior tumor regression.

IL-18 is proinflammatory cytokine belonging to the IL-1 family, which regulates both innate and adaptive immune responses by activating monocytes, NK cells, and T cells and production of IFN-γ as well as other cytokines in vivo (Srivastava et al., *Curr Med Chem*, 2010, 17:3353-7). The results presented herein indicates that IL-18 has little impact on CAR-T cell's expansion, phenotype and function in ex vivo experiments, as most of the results in IL-18 groups are similar and comparable with NC group. IL-18 promoted little proliferation of T cells and maintained more T cell survival under antigen challenge compared to the control (NC) group. In vivo studies show that IL-18 has no significant impact on CAR-T cell efficacy when compared with mice without cytokine supplement.

In summary, the findings of these experiments indicate that IL-2 supplement ex vivo for CAR-T cell expansion is not an optimal strategy although it is widely used. As to IL-18, IL-21 or no cytokine supplement, although they may induced relative effective CAR-T cells, they do not promote CAR-T cell expansion effectively enough, such that enough CAR-T cells could be prepared for clinical use in a limited expansion time. Therefore, IL-15 and IL-7 may be better agents for CAR-T cell expansion. Furthermore, the combination of IL-7 and IL-15 supplement instructs the generation of Tscm, which is beneficial to produce more "young" CAR-T cells. As to in vivo cytokine injection, all γc cytokines supplement enhance antitumor efficacy, as many of them favor the expansion of CAR-T cells, with IL-15 presenting best effect. Mice receiving IL-15 exposed CAR-T cells by injection had increased efficacy, due in part to the increased expansion ability and increased persistence of the CAR-T cells during tumor treatment. Thus, the results of these experiments indicate that IL-7 and IL-15 show promise to promote CAR-T cell expansion and induce T cell phenotypes that are most efficacious for therapeutic treatment.

Example 2: Effect of CD25 Depletion on Cell Growth and Transduction Efficiency

The interleukin-2 a-chain, also known as CD25, is expressed by regulatory T cells (Tregs) but has also been observed on chronic B cell leukemia (CLL) cells (in greater than 85% of CLL patients). Tregs have immune suppressing functions and can impede the efficacy of immunotherapy, e.g., by inhibiting T cell proliferation. Current isolation or enrichment of T cells from CLL patients by apheresis usually contains a significantly increased proportion of Tregs as well as CLL cells. The depletion of Tregs and CLL cells in the starting material by CD25 depletion methods may significantly improve the purity of effector T cells, and thereby increase the potency of CAR19 expressing T cells, e.g., CART19 cells.

Optimizing CD25 Depletion

A validation experiment was performed to identify the optimal conditions for CD25 depletion from the aphereses from two patients using CD25 Reagent from Miltenyi in a CliniMACS System. CD25 depletion reagent was used at 100%, 70%, and 30% of the manufacturer's recommended amount to identify whether the same depletion efficiency could be obtained by using less reagent. Two different tubing sets from Miltenyi were also tested. The depletion was performed in accordance with the manufacturer's directions. The results from the experiments are shown in the table below. For control, selection using anti-CD3/CD28 immunomagnetic beads was performed.

TABLE 2

Experimental results from CD25 depletion.

| CD25 depletion arms | | 100% | 70% | 30% |
|---|---|---|---|---|
| Miltenyi tubing set | 161-01 | | | |
| CliniMACS program | ENRICHMENT1.1 | | | |
| Patient cells | UPCC0440945 | | | |
| % CD45 + CD25+ cells | 83.56% | | | |
| % CD45 + CD3+ cells | 8.66% | | | |
| % CD45 + CD3 + CD25− cells | 5.70% | | | |
| #CD25+ cells to tarot | | 2.E+09 | 2.E+09 | 2.E+09 |
| #apheresed cells for CD25 depletion | | 2.39E+09 | 3.41E+09 | 7.97.E+09 |
| CD25 bead volume used (mL) | | 2.5 | 2.5 | 2.5 |
| Cell# in CD25—depleted fraction | | 1.05E+09 | 1.86E+09 | 3.36E+09 |
| Cell# in CD25—enriched fraction | | 2.05E+08 | 2.58E+08 | 5.19E+08 |
| Expected CD25− T-cell yield | | 1.36E+08 | 1.95E+08 | 4.54E+08 |
| % T cells in depleted fraction | | 6.26% | 4.08% | 2.50% |
| Observed yield CD25− T cells | | 6.57E+07 | 7.55E+07 | 8.40E+07 |
| Yield of CD3 + CD25− as % of expected | | 48% | 39% | 18% |
| % B cells in depleted fraction | | 90.50% | 91.6% | 95.30% |
| Viability CD25+ fraction | | 94.4% | 96.2% | 91.1% |
| Viability CD25− fraction | | 95.8% | 95.0% | 99.0% |

The expected CD25-(CD25-negative) T cell yield represents the calculated CD25− T cell yield calculated by assuming 100% efficiency in the respective manipulations. The observed yield of CD25− T cells represents the number of CD25− T cells after the respective manipulations. As shown in Table 2, using less reagent than recommended by the manufacturer did not result in the same efficiency in CD25 depletion. Using different tubing resulted in an increase in T cell enrichment by one log.

Figure 9:
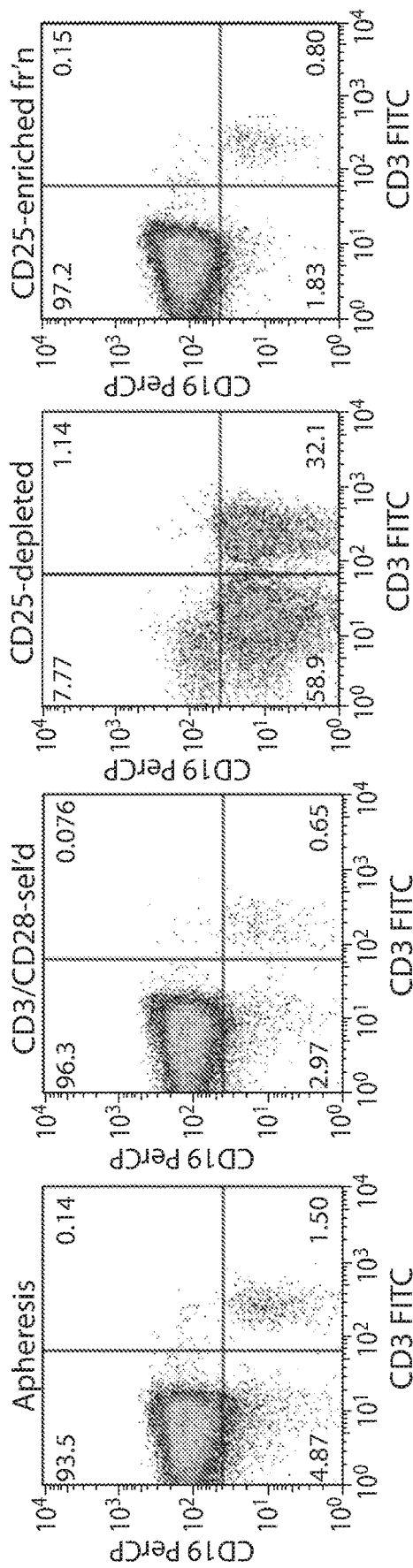
FIG. 9 is a series of FACS plots (top) showing the CD3 and CD19 populations and histograms (bottom) showing CD14 expression of cells from apheresis, cells selected with anti-CD3/CD28, cells depleted for CD25, and the CD25 enriched cells.

FIG. 9 shows representative flow cytometry analysis plots demonstrating the efficiency of CD25 depletion compared to the total cells from the apheresis, control CD3/CD28 selected cells, CD25 depleted cells, and CD25 enriched cells. The monocyte content of the cell population, as determined by CD14 expression of the CD3-CD19− subset. These results indicate efficient CD25 depletion and that CD25 depletion also resulted in significant monocyte content (61.1% CD14-expressing cells compared to less than 2% in the total cells from apheresis, control, and the CD25 enriched cells.

Effect of CD25 Depletion on T Cell Population and Proliferation

Next, the quality of the T cell product after CD25 depletion was assessed by determining the proportion of CD4+ and CD8+ T cells and proliferation capacity.

To determine the proportion of specific T cells populations, cells were analyzed by flow cytometry nine days after selection by anti-CD3/CD28 or CD25 depletion as described above. The results show that CD3/CD28-selected T cells had a greater proportion of CD4+ T cells compared to CD25 depleted cells (84.6% compared to 46.8% CD4+ T cells). Conversely, CD25 depleted cells had a greater proportion of CD8+ T cells compared to the CD3/CD28− selected cells (47.2% compared to 11.5% CD8+ T cells). Therefore, CD25 depletion results in T cells with a greater proportion of CD8+ T effector cells.

Figure 10A:
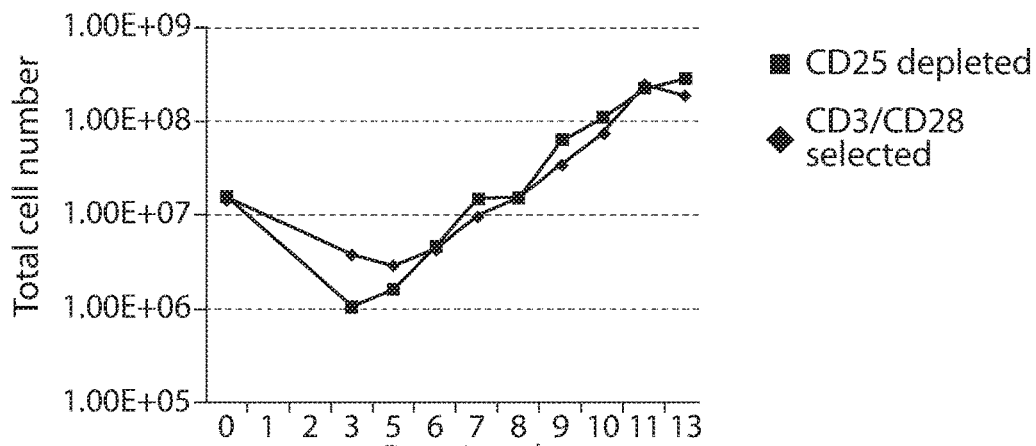
FIGS. 10A, 10B, and 10C show the comparison of proliferation capacity between CD3/CD28 selected cells and CD25 depleted cells.
Figure 10B:
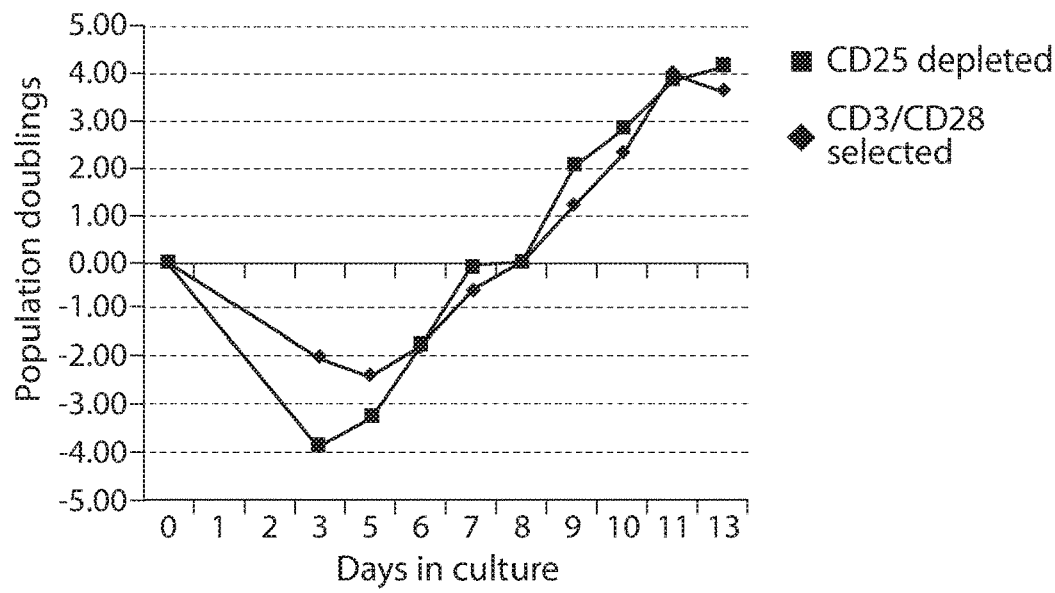
Figure 10C:
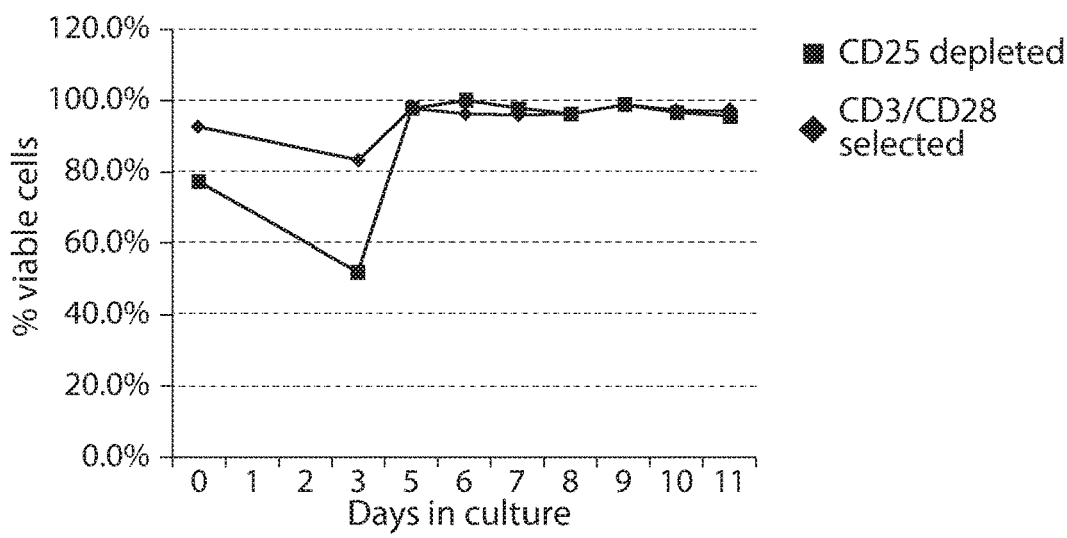

Proliferation capacity and cell viability was also assessed in control (CD3/CD28 selected cells) and CD25 depleted cells. $1.6 \times 10^7$ cells from control and CD25 depleted cells were plated and the cell number and viability was determined over 10-13 days. FIG. 10A shows the total cell number over time and FIG. 10B shows the calculated population doublings (calculated from the total number of cells). The results indicate that the CD25 depleted cells demonstrated similar growth characteristics to the control cells. FIG. 10C shows the percentage of viable cells, and the results show that viability was also similar between control and CD25 depleted cells.

Effect of CD25 Depletion on Lentiviral Transduction Efficiency

The effect of CD25 depletion on lentiviral transduction efficiency was assessed by determining the expression of CAR after transduction. A patient apheresis was depleted with CD25 cells as described above. The efficiency of the CD25 depletion is demonstrated in the flow cytometry analysis plots comparing the CD25-expressing population before (apheresis sample) and after CD25 depletion (CD25-depeleted fraction). After CD25 depletion, the CD25 depleted fraction contained about 59.2% of CD25 negative cells and only 10.3% CD25 positive cells.

The CD25 depleted fraction was transduced with a lentiviral construct encoding CAR19. After 11 days of culture, CAR expression was assessed by flow cytometry. Cells that were untransduced and transduced CD3 selected cells were used as controls. CAR19 expression was significantly higher in CD25 depleted cells compared to CD3 selected cells (51.4% compared to 12.8%). This result demonstrates that CD25 depleted cells have improved lentiviral transduction efficiency, which may be important for improved therapeutic effect in CART therapy.

Example 3: Using Cytokines with CD25-Depleted Cells

In this example, the effect of CD25 depletion with cytokine supplement during expansion in culture was examined. Peripheral blood mononuclear cells (PBMCs) were isolated from a patient and were either left unmanipulated or were depleted of CD25-expressing cells as described in Example 2. T cell enrichment was achieved by stimulation with anti-CD3 and CD28 coated beads. The T cells were immediately cultured in media supplemented with 10 ng/ml IL-7, 10 ng/ml IL-15, or the combination of 10 ng/ml IL-7 and 10 ng/ml IL-15. At day 3, medium was changed with the same cytokines added. At day 5, the medium containing 100 IU IL-2/ml was added, and the cells were grown for a total of 10 days.

Figure 11:
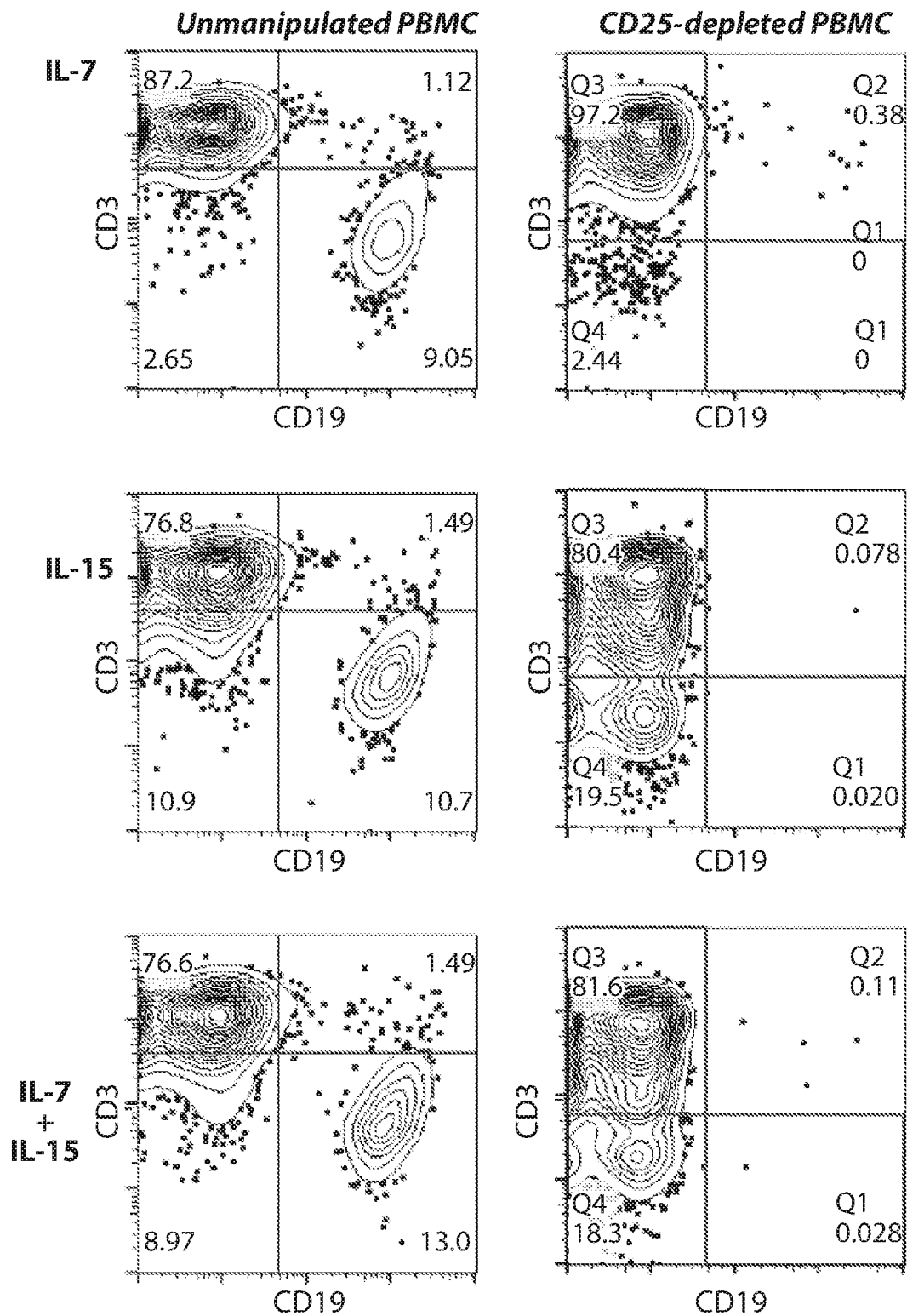
FIG. 11 is a series of FACs plots showing the distribution of CD3 and CD19 in unmanipulated PBMCs and CD25-depleted PBMCs after culture with the indicated cytokine supplements, IL-7, IL-15, or IL-7 and IL-15.
Figure 12:
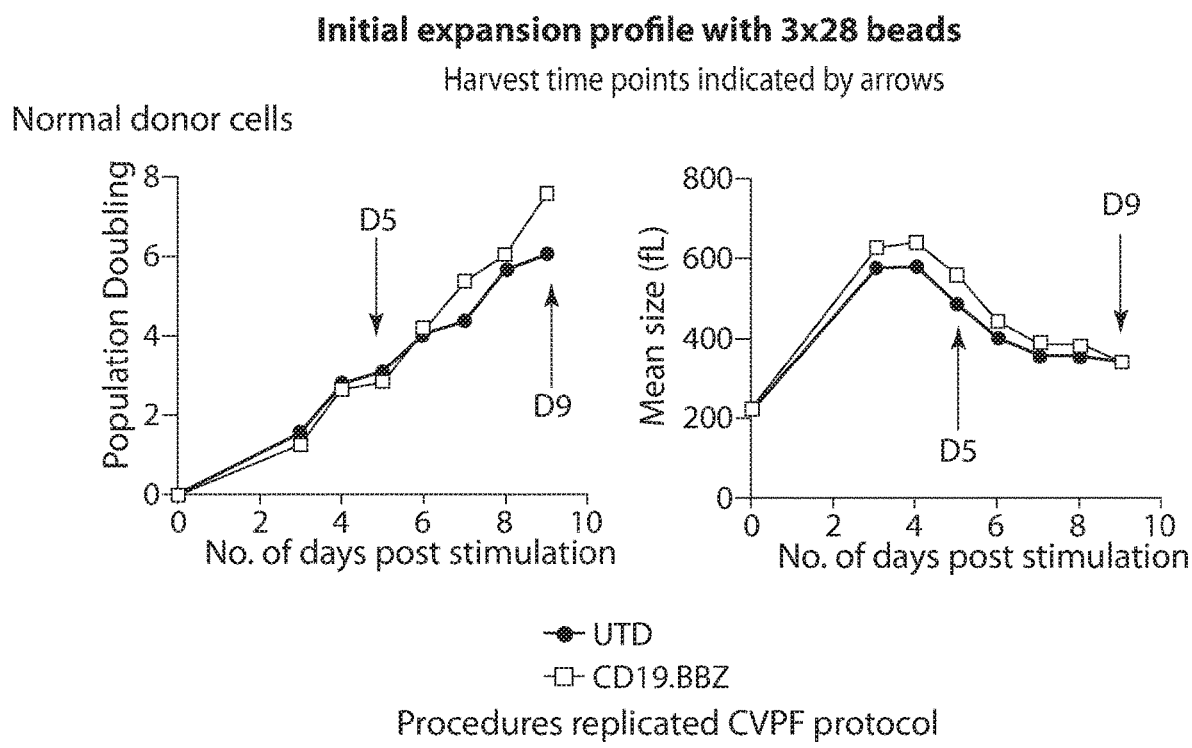
FIG. 12 is a set of graphs showing expansion profile in population doublings (left hand graph) and mean size (fL) (right hand graph) of PBMCs that have been stimulated with anti-CD3 and CD28 beads, and left either unmanipulated (UTD) or transduced with a CD19 CAR (CD19.BBz), de-beaded, and then harvested at Day 5 and D9.
Figure 13:
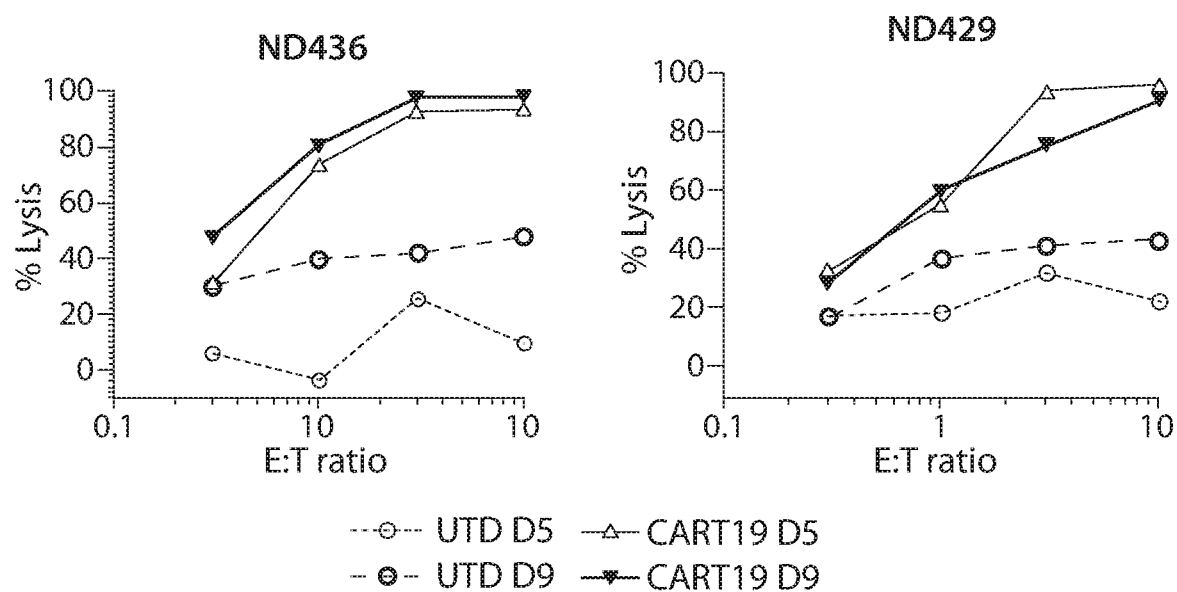
FIG. 13 is a set of graphs depicting cytotoxicity as a percent lysis of CD19 expressing K562 cells treated with PMBCs that have been stimulated with anti-CD3 and CD28 beads, and left either unmanipulated (UTD) or transduced with a CD19 CAR (CD19.BBz), de-beaded, and harvested at Day 5 and D9.
Figure 14:
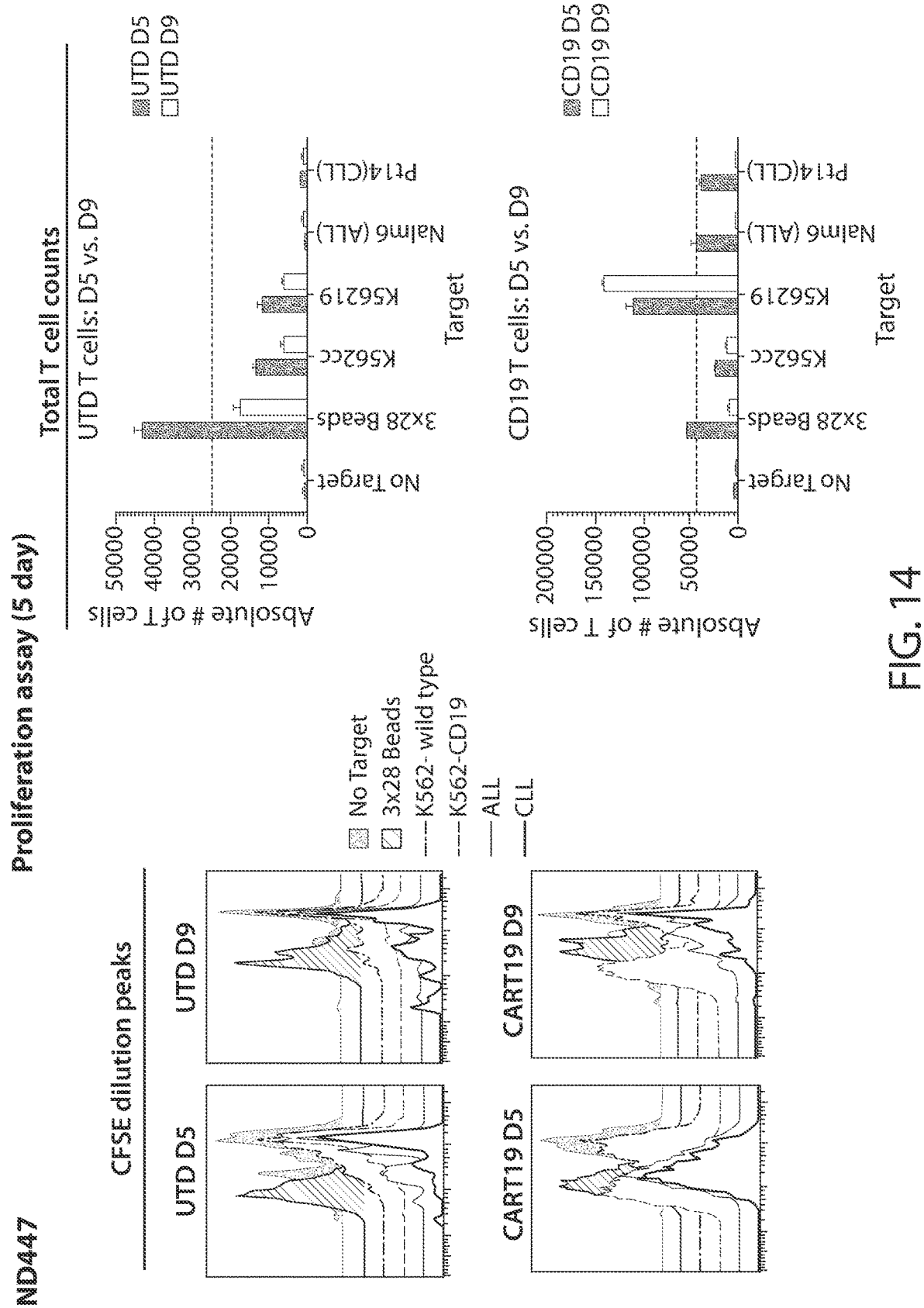
FIG. 14 is a set of graphs depicting proliferation of PBMCs stimulated with anti-CD3 and CD28 beads (3×28 beads), wild type K562 cells, CD19 expressing K562 cells, ALL cells (Nalm6) or CLL cells (PI14). The PBMCs have been left either unmanipulated (UTD) or transduced with a CD19 CAR (CART19), de-beaded, and then harvested at Day 5 and D9.
Figure 15:
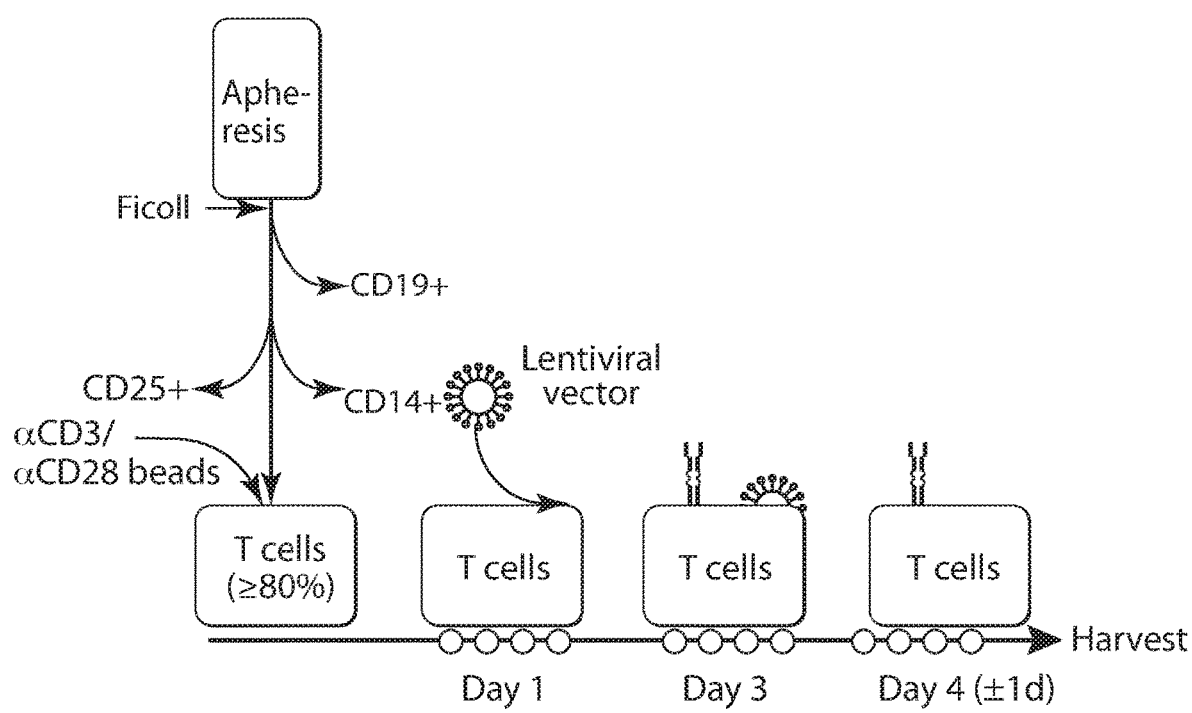
FIG. 15 is a schematic of an exemplary manufacturing scheme.
Figure 16:
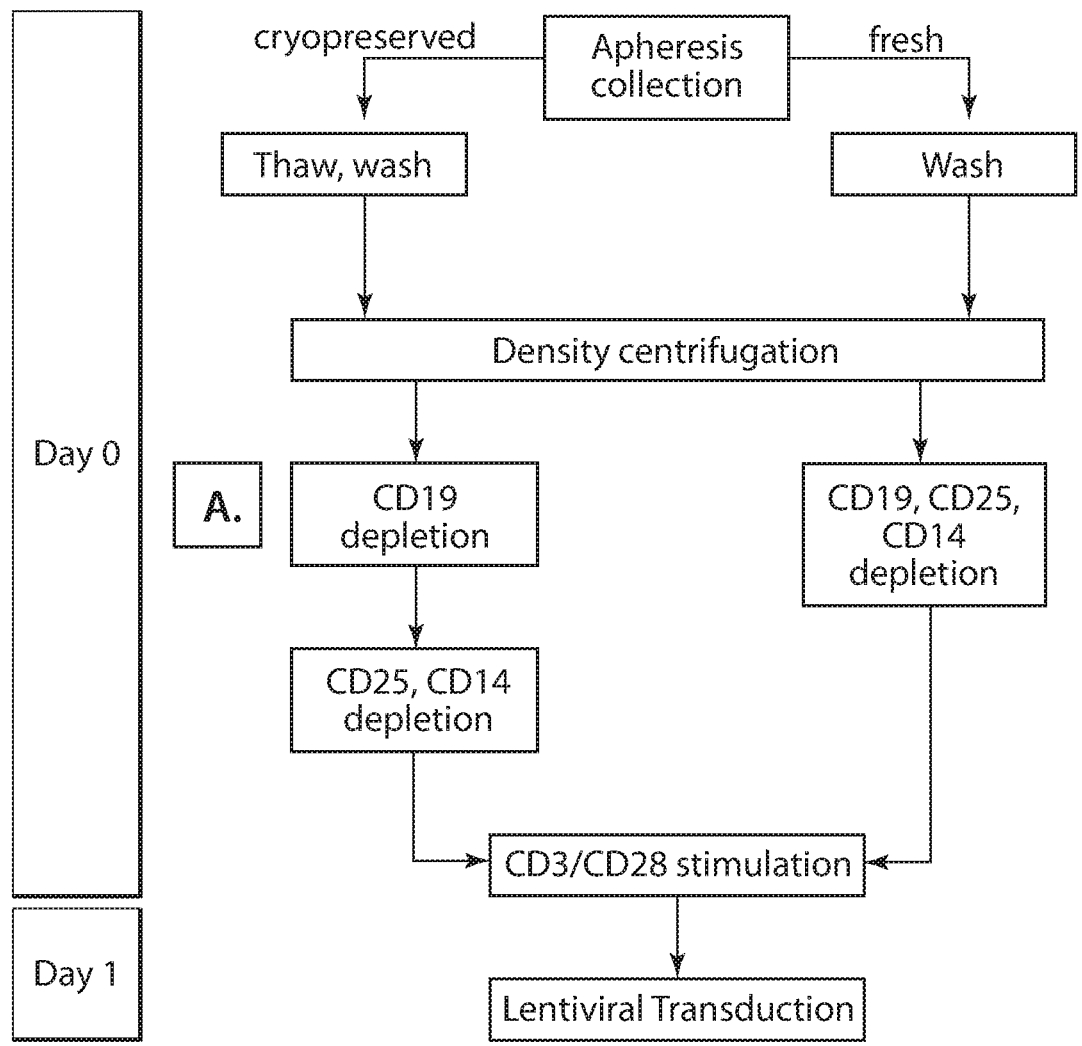
FIG. 16 is a schematic of an exemplary manufacturing scheme.
Figure 17:
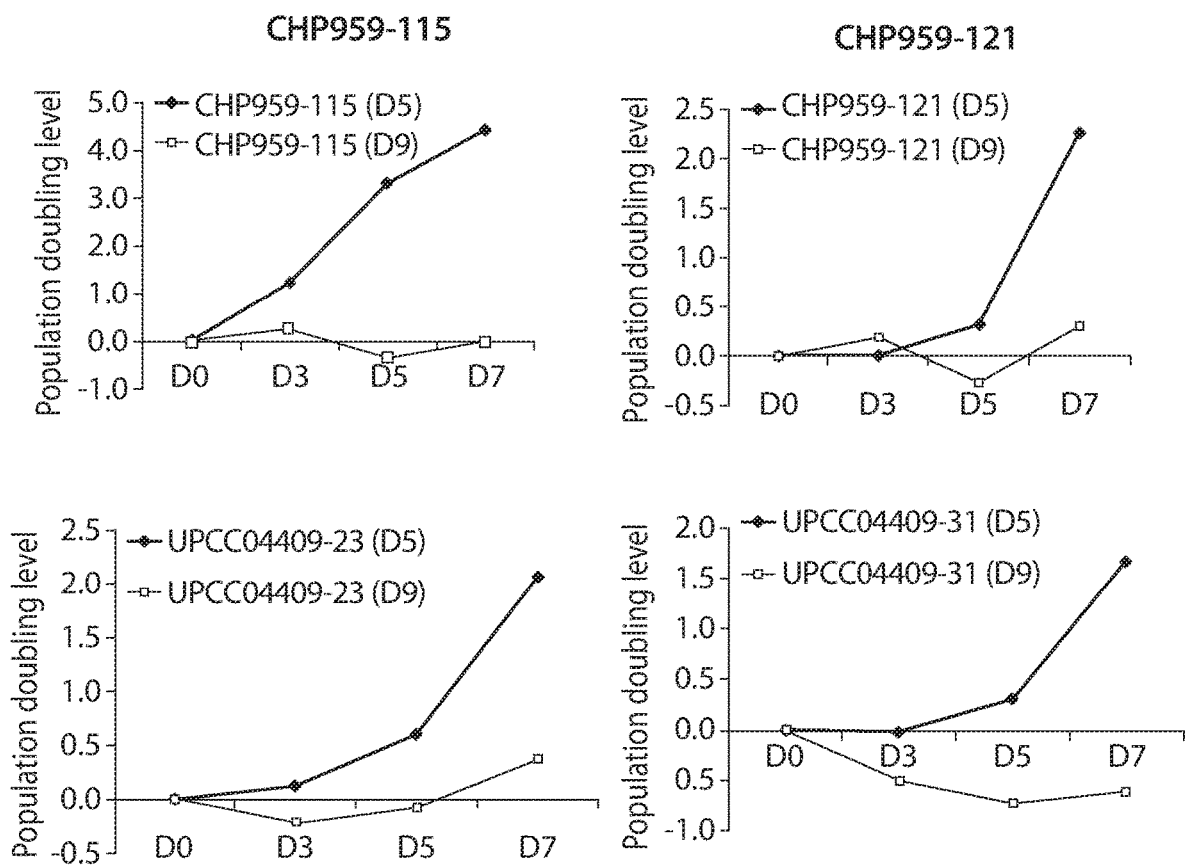
FIG. 17 is a set of graphs depicting the level of cell proliferation of two different manufacturing batches of donor cells transfected with the CTL019 CAR, CHP959-115 and CHP959-121, expanded over a period of 0 to 9 days.
Figure 18:
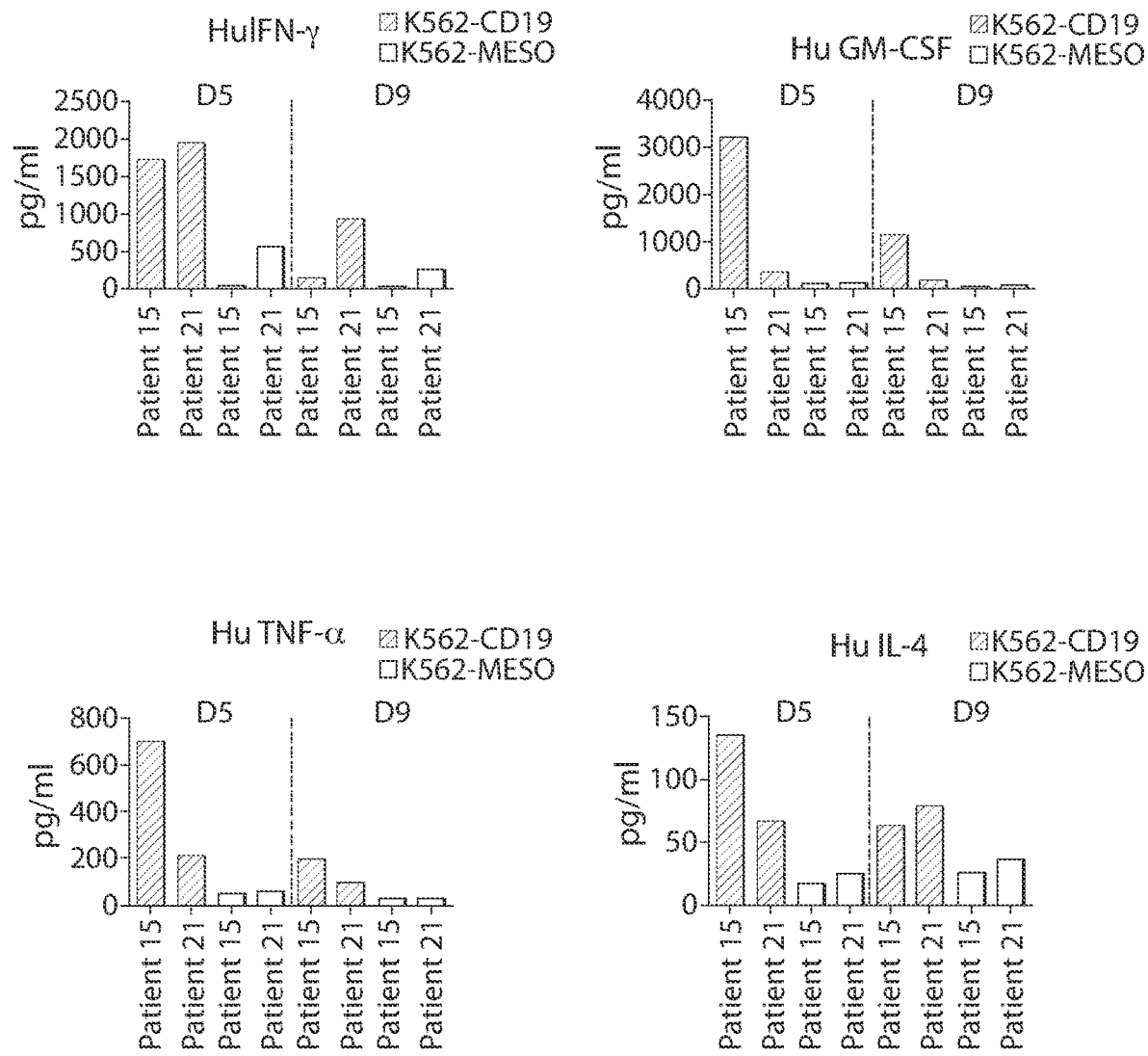
FIG. 18 is a set of graphs showing proinflammatory cytokine production, IFN-γ, GM-CSF, TNF-α and IL-4 of two different manufacturing batches of donor cells transfected with either CTL019 CAR, namely CHP959-115, or an ssl-mesoCAR, namely and CHP959-121, and expanded over a period of 0 to 9 days after apheresis.
Figure 19:
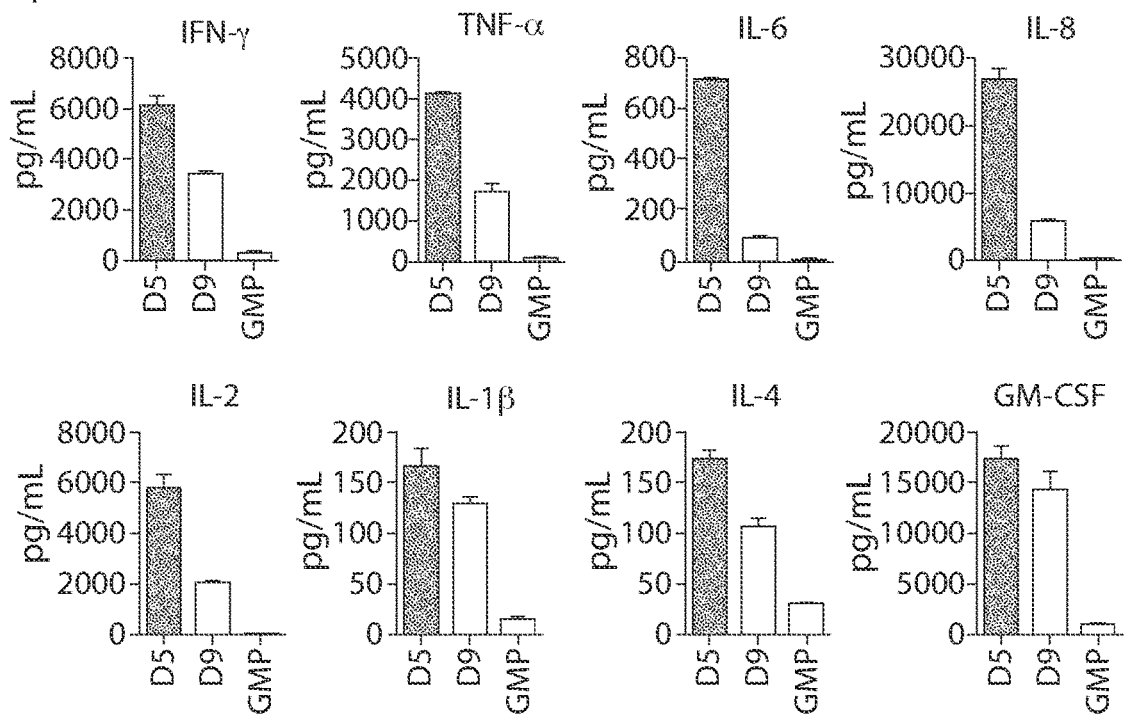
FIG. 19 is a set of graphs depicting production levels IFN-γ, TNF-α, IL-6, IL-8, IL-2, IL-1β, GM-CSF and IL-4 in donor cells stimulated with anti-CAR19-idiotype antibody beads or control beads, transfected with CTL019 CAR and expanded for 5 to 9 days. No cytokine or low cytokine levels (<200 pg/ml) were detected with the control beads.
Figure 20:
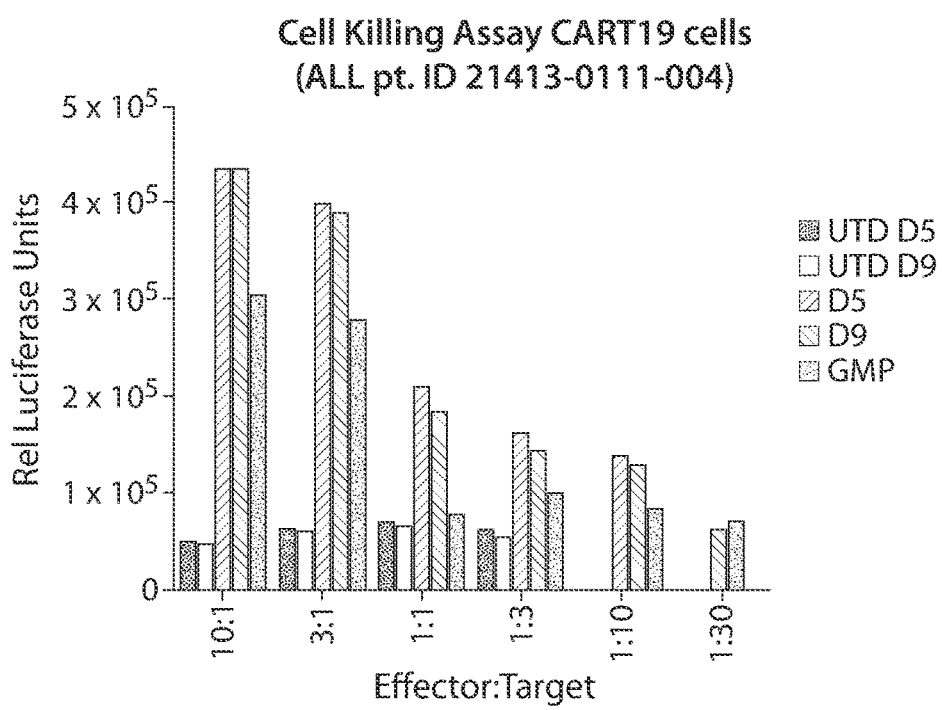
FIG. 20 is a graph depicting cell killing based upon total lysates using a luciferase assay of Nalm6 (ALL) cells of PBMCs left either unmanipulated (UTD) or transduced with a CD19 CAR (CART19), de-beaded, and then harvested at Day 5 and D9. Various ratios of PMBCs to Nalm6 cells (effector (E):Target (T)) were cultured. As shown CART19 cells harvested at day 5 posses a better killing capacity.
Figure 21:
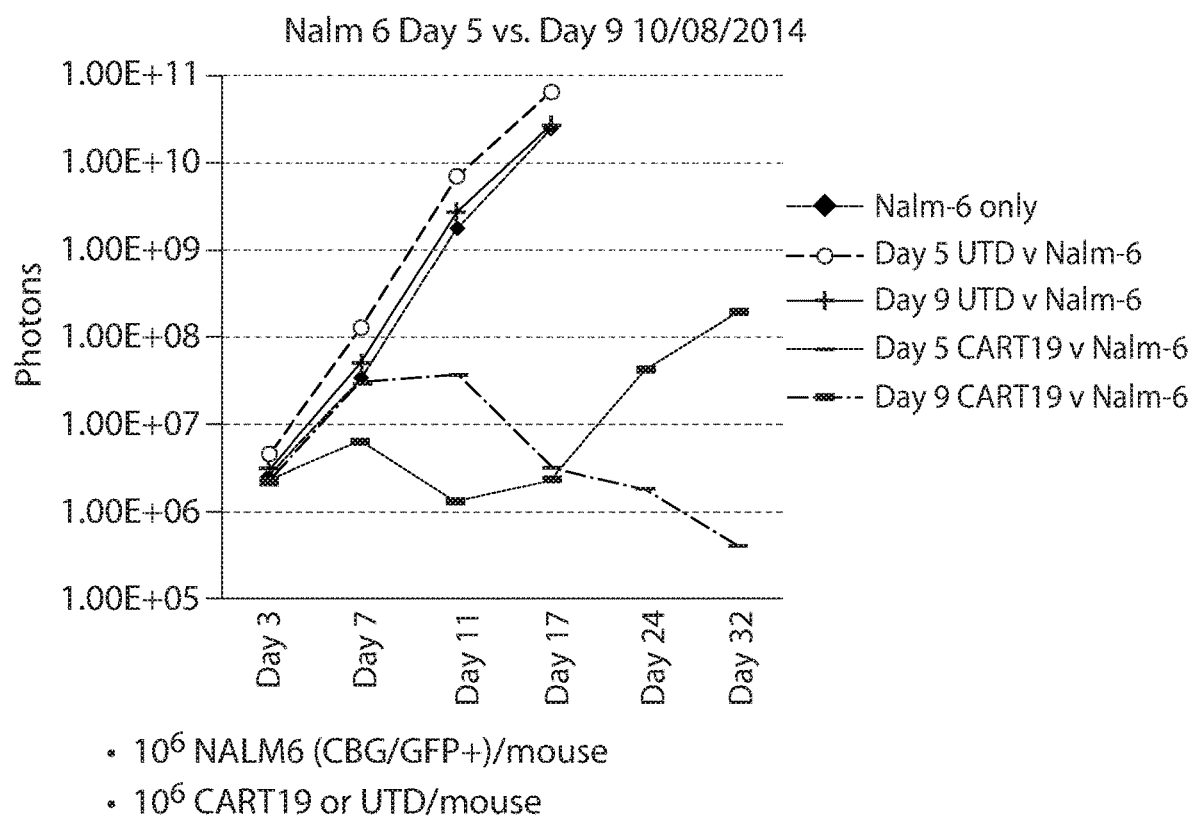
FIG. 21 is a graph depicting long term in vivo killing capacity of PBMCs left either unmanipulated (UTD) or transduced with a CD19 CAR (CART19), de-beaded, and then harvested at Day 5 and D9. The PBMCs were introduced into non-obese diabetic/severe combined immunodeficiency mice inoculated with Nalm6 cells.

Flow cytometric analysis shows the change in distribution of CD3 and CD19 cells in CD25 depleted cells compared to unmanipulated PBMC (standard CD3/CD28 selection) after culture in the presence of IL7, IL-15, or IL7 and IL15. The distribution of CD3, CD19, and CD25 expressing cells in the starting population (e.g., before CD25 depletion and before culture with cytokine supplementation) was assessed. The starting population had a high proportion of CD3−CD19+ cells (~97.2%) and a high proportion of CD25-expressing cells (~94.5% CD25+ CD3−; and ~93.8% CD25+ CD19+). After manipulation (CD25 depletion) and culture with cytokines, the distribution changed as shown in FIG. 11. CD25 depleted cells overall showed greater reduction in CD19-expressing cells compared to the unmanipulated cells.

Proliferation capacity was also assessed for the same cell samples by determining the total number of cells in culture at day 10 after stimulation with anti-CD3 and anti-CD28 coated beads. The cell numbers for each cell sample are shown below.

TABLE 3

| Cells | Cytokines added | # Cells in culture |
|---|---|---|
| In vitro expansion | | |
| Unmanipulated | IL-7 | $1.24 \times 10^6$ |
| | IL-15 | $0.92 \times 10^6$ |
| | IL-7 + IL-15 | $0.52 \times 10^6$ |
| CD25—depleted | IL-7 | $0.93 \times 10^6$ |
| | IL-15 | $1.95 \times 10^6$ |
| | IL-7 + IL-15 | $3.03 \times 10^6$ |

These results show that supplementation of IL-15 during culture of CD25 depleted T cells resulted in increased expansion compared to unmanipulated cells. Addition of IL-7 and IL-15 in the media during culture resulted in significant increase in expansion compared to unmanipulated cells, and compared to adding the cytokines IL-7 or IL-15 independently. Thus, the combination IL-7 and IL-15 supplement resulted in T cells with the most increased proliferation capacity.

Example 4: Fitness of T Cells for Use in Cellular Therapy

The use of engineered cellular therapy has demonstrated significant success in the last five years, specifically in clinical trials targeting B-cell malignancies with chimeric antigen receptor (CAR) T cells targeting CD19. Despite these promising results, many patients undergoing evaluation for enrollment are ultimately unable to proceed due to lack of a sufficient cellular product. This limitation arises as a result of either an inability to harvest adequate lymphocytes from the peripheral blood, or as a result of failed ex vivo cellular expansion, which is a component of cell manufacturing and a predictor of in vivo activity. At the time of evaluation of many patients, more than 30% of patients do not have sufficient cellular material for the successful clinical manufacturing of a cell therapy product. This example describes the identification of factors that may influence peripheral T cell harvest, such as timing of harvest and chemotherapy that may affect T cell counts. These factors are of significant clinical relevance as trials of CAR T cells grow larger and more numerous. In particular, T cell expansion potential and memory phenotype during chemotherapy in pediatric patients with ALL and NHL were investigated.

Methods

Patient Selection and Clinical Protocol

The expansion capability and phenotype of T cells harvested from pediatric patients with hematologic malignancies were analyzed before initiation of chemotherapy and after each cycle of chemotherapy. Patients were identified by the clinical practices at the Children's Hospital of Philadelphia Division of Hematology and Oncology in Philadelphia, PA. Patients were enrolled onto Children's Hospital of Philadelphia Institutional Review Board-approved clinical trial CHP-12-009915. Inclusion criteria were defined as follows: males or females aged 6 months to 21 years; diagnosis of CD19-positive B cell malignancy; no previous gene therapy (patients may have received CD19 CAR T cell therapy if it was followed by myeloablative stem cell transplant); parental/guardian informed consent; and, if appropriate, child assent. Exclusion criteria were defined as follows: active hepatitis B or C infection; HIV infection; any uncontrolled medical condition that would preclude participation; and parents or guardians who, in the opinion of the investigator, may be noncompliant with study procedures.

Consent and enrollment were performed by David M. Barrett, and a four milliliter sample of peripheral blood was collected in addition to routine labs, which was used for study. This was the solitary trial intervention, and all patients continued with standard-of-care therapy based on disease, with a similar collection occurring after each cycle of chemotherapy. Peripheral blood samples were collected from patients diagnosed with acute lymphoblastic leukemia (ALL) or non-Hodgkin lymphoma (NHL) using an IRB approved clinical trial protocol (CHP-12-009915) at the following time points: pre-chemotherapy, post-induction, post-consolidation, post-interim maintenance, post-delayed intensification, and maintenance. Patients with relapsed disease were excluded from enrollment. Patient characteristics are shown in Table 7. Patient age at time of enrollment ranged from 8 months to 19 years, and patients were 58% male and 42% female. Disease groups included ALL, stratified as National Cancer Institute (NCI) SR (SR-ALL, n=17) or HR/VHR (HR/VHR-ALL, n=21), and NHL (n=12). Lymphoma subtypes included Burkitt (n=6), diffuse large B cell (DLBCL, n=3), primary mediastinal (n=1), primary lymphoma of bone (n=1), and follicular lymphoma (n=1); all NHL subtypes were grouped for analysis. Chemotherapeutic regimens for standard and high-risk ALL are shown in Table 8.

TABLE 7

Patient characteristics

| Characteristic | Total (n = 50) |
| --- | --- |
| Age (yr) | |
| Median | 5 |
| Range | 0.7-19 |
| Sex—no. (%) | |
| Male | 29 (58) |
| Female | 21 (42) |
| Disease—no. (%) | |
| ALL | 38 (76) |
| Standard-risk | 17 (34) |
| High and very high-risk | 21 (42) |
| NHL | 12 (24) |
| Burkitt | 6 (12) |
| DLBCL | 3 (6) |
| Primary mediastinal | 1 (2) |
| Primary of bone | 1 (2) |
| Follicular | 1 (2) |

TABLE 8

Therapy regimens given to standard-risk ALL and high-risk ALL patients

| | Standard-risk ALL | High-risk ALL |
| --- | --- | --- |
| Induction | Vincristine 6 mg/m$^2$<br>Dexamethasone 6 mg/m$^2$<br>PEG-L-asparaginase 2500 U/m$^2$ | Vincristine 6 mg/m$^2$<br>Dexamethasone 6 mg/m$^2$<br>PEG-L-asparaginase 2500 U/m$^2$ |
| Consolidation | Vincristine 1.5 mg/m$^2$<br>6-mercaptopurine 75 mg/m$^2$ | <u>Daunorubicin 100 mg/m$^2$</u><br>Vincristine 1.5 mg/m$^2$<br>6-mercaptopurine 60 mg/m$^2$<br><u>Cyclophosphamide 1 g/m$^2$</u><br><u>Cytarabine 75 mg/m$^2$</u><br><u>PEG-L-asparaginase 2500 mg/m$^2$</u> |
| Interim maintenance | Vincristine 7.5 mg/m$^2$<br>Methotrexate 500 mg/m$^2$ | <u>Vincristine 7.5 mg/m$^2$</u><br><u>Methotrexate 20 mg/m$^2$</u><br><u>6-mercaptopurine 25 mg/m$^2$</u> |
| Delayed intensification | Vincristine 4.5 mg/m$^2$<br>Dexamethasone 10 mg/m$^2$<br>Doxorubicin 75 mg/m$^2$<br>PEG-L-asparaginase 2500 U/m$^2$<br>Cyclophosphamide 1 g/m$^2$<br>Cytarabine 60 mg/m$^2$<br>6-thioguanine 60 mg/m$^2$ | <u>Vincristine 7.5 mg/m$^2$</u><br>Dexamethasone 10 mg/m$^2$<br>Doxorubicin 75 mg/m$^2$<br>PEG-L-asparaginase 5000 U/m$^2$<br>Cyclophosphamide 1 g/m$^2$<br>Cytarabine 60 mg/m$^2$<br>6-thioguanine 60 mg/m$^2$ |
| Interim maintenance II* | Vincristine 7.5 mg/m$^2$<br>Methotrexate 500 mg/m$^2$ | |
| Maintenance | Vincristine 1.5 mg/m$^2$<br>Dexamethasone 6 mg/m$^2$<br>6-mercaptopurine 75 mg/m$^2$<br>Methotrexate 20 mg/m$^2$ | Vincristine 1.5 mg/m$^2$<br>Prednisone 40 mg/m$^2$<br>6-mercaptopurine 75 mg/m$^2$<br>Methotrexate 20 mg/m$^2$ |

Underlined text indicates therapy not given to standard-risk patients.
*T cells collected after interim maintenance II phase for standard-risk ALL were not analyzed, as there was no corresponding cycle for high-risk (HR) or very high-risk (VHR) disease.

Ex Vivo T Cell Expansion and Culture

Lymphocytes were harvested from peripheral blood using Ficoll-Paque (GE Life Sciences) density centrifugation medium as per standard protocol. The harvested buffy coat was resuspended in T cell culture medium, and cells were plated on appropriate-sized culture vessels at a concentration of 5 to 10×10$^6$ cells/ml and incubated overnight at 37° C. After this 18- to 24-hour incubation, the supernatant from these cultures was collected and washed, leaving adherent cells in culture vessels and isolating only suspension cells. A sample of this supernatant was stained for CD3, CD4, and CD8 expression (see below) to calculate ATCs. This full culture was then combined with stimulatory microbeads coated with CD3 and CD28 agonist antibodies (Life Technologies; catalog #111.32D) at a ratio of three beads per T cell, and resuspended at a concentration of 10$^6$ Tcells/ml for Tcell expansion, with the same stimulation and culture conditions used in our clinical test expansions. Cells were counted, cell sizes were measured every other day, and beads were removed on day 7. Culture period ended when cell growth kinetics and volume indicated that the cells had rested down from activation. For cytokine studies, samples were collected as described and combined with beads, then split into two cultures. One culture (no cytokine) was treated as above, and the other (+IL-7 and IL-15) was treated with IL-7 (25 ng/ml) and IL-15 (10 ng/ml) (R&D Systems, #207-IL-025 and #247-IL-205).

The influence of diagnosis and chemotherapy on the chance of successful response to CD3/CD28 stimulation of cells was assessed. A standard of >5-fold cell expansion over 10 days was applied to the cultured cells. This standard is clinically relevant to engineered cell therapy trials, as it has been used a threshold for minimal expansion necessary to be enrolled in clinical trials of CD19 CAR T cells. Statistical analysis was performed on GraphPad Prism software and analysis of variance was used to compare groups.

Flow Cytometry

T cells were stained for cell surface markers to differentiate T cell lineage. CCR7, CD62L, CD45RO and CD95 can be used to differentiate the various T cell phenotypes by using the following expression patterns: naïve ($T_N$)—CCR7+, CD62L+, CD45RO−, CD95−; stem central memory ($T_{SCM}$)—CCR7+, CD62L+, CD45RO−, CD95+; central memory ($T_{CM}$)—CCR7+, CD62L+, CD45RO+, CD95+; effector memory ($T_{EM}$)—CCR7−, CD62L−, CD45RO+, CD95+; terminal effector ($T_{Eff}$)—CCR7−, CD62L−, CD45RO−, CD95+. See, e.g., Gattinoni et al. Nat. Med. 17(2011):1290-7. The antibodies used for both this analysis, as well as quantitation of T-cell bulk described above, were CD8-FITC (BD Biosciences, Franklin Lakes, NJ; #347313), CD3-PE (BD Biosciences, #555340), CD4-APC (BD Biosciences, #555349), CCR7-FITC (BD Biosciences, #561271), CD95-PE (BD Biosciences, #556641), CD45RO (BD Biosciences, #559865) and CD62L-PE/Cy7 (BioLegend, San Diego, CA; 304822). Cells were resuspended in FACS buffer (PBS+1% fetal calf serum) then incubated with antibody cocktails for 25 minutes at 4° C. Samples were then washed twice and flow cytometry acquisition was performed on a BD FACS Verse Flow Cytometer (BD Biosciences, #653118). Analysis was performed using FlowJo software (Treestar, Inc, Ashland, OR).

Statistical Analysis

All statistical analysis was performed using Prism 4 (Graphpad Software, La Jolla, CA) using analysis of variance testing. Fisher's exact test was used for comparison of percentages. All comparisons that are reported as significant reached a p-value <0.05, or as calculated for Bonferroni corrections for multiple comparisons.

Results

A greater than five-fold expansion in vitro during test expansion is highly predictive of successful clinical-scale expansion, with a positive predictive value of 70% and a negative predictive value of 95%.

T Cell Expansion Varied by Disease Group and Previous Therapy

Peripheral blood was collected from each enrolled patient at diagnosis and after every cycle of chemotherapy. The chemotherapeutic regimens administered to SR- and HR-ALL patients during these cycles are shown in Table 8. T cells were isolated and stimulated using beads coated with CD3 and CD28 agonist antibodies, and cell expansion was measured over time. A threshold of greater than fivefold expansion during test expansion (which is associated with a high likelihood of successful clinical expansion) was applied to stratify the analysis into samples that "pass" expansion and those that "fail" expansion. These categories represented those patient samples that would have been eligible or ineligible, respectively, for inclusion in clinical trials.

ALL v. NHL

Figure 22A:
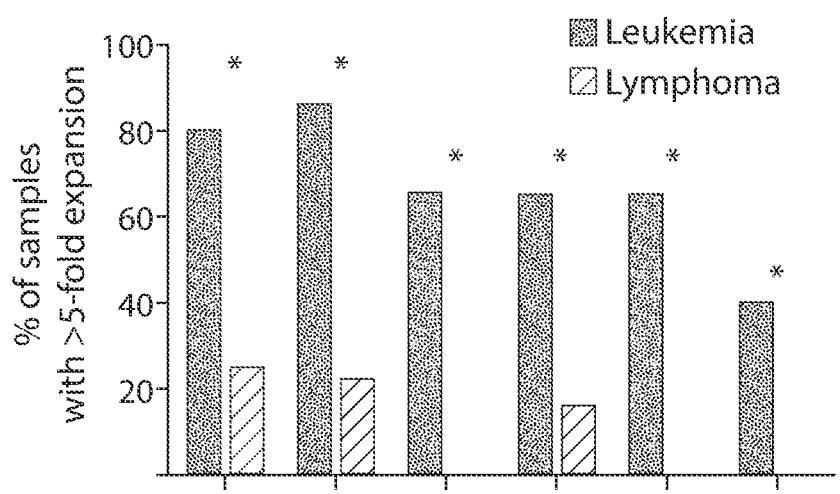
FIG. 22A is a bar graph showing the percentage of peripheral blood samples that passed test expansion from patients with ALL and NHL.

Nearly 80% of patients with ALL met this threshold at diagnosis, with pass rates slowly declining over the course of therapy, reaching ~40% during maintenance phase (FIG. 22A). In distinct contrast were cells collected from patients with NHL, which demonstrated poor expansion, with only 25% passing at diagnosis, and few samples (12.5% of all remaining time points) demonstrating any expansion after initiation of therapy (FIG. 22A). The difference in pass rates between leukemia and lymphoma samples was significant at all time points (Table 12 shows results of the statistical analysis).

TABLE 12

Statistical analysis of data from FIG. 22A-22F, with significant values underlined.

| | % passing test expansion | Absolute T-cell count | |
|---|---|---|---|
| Leukemia v. Lymphoma | 0.005 | 0.140 | Pre-chemo |
| | <u>0.013</u> | 0.490 | Post-induction |
| | <u>0.025</u> | 0.320 | Post-consolidation |
| | <u>0.012</u> | 0.260 | Post-DI |
| | <u>0.025</u> | 0.060 | Post-IM |
| | <u>0.003</u> | 0.360 | Maintenance |
| SR-ALL v. HR/VHR-ALL | 0.210 | 0.314 | Pre-chemo |
| | 0.120 | 0.470 | Post-induction |
| | <u>0.003</u> | <u>0.009</u> | Post-consolidation |
| | <u>0.007</u> | <u>0.008</u> | Post-DI |
| | <u>0.012</u> | 0.275 | Post-IM |
| | <u>0.023</u> | <u>0.004</u> | Maintenance |

Standard Risk v. High/Very High Risk

Figure 22B:
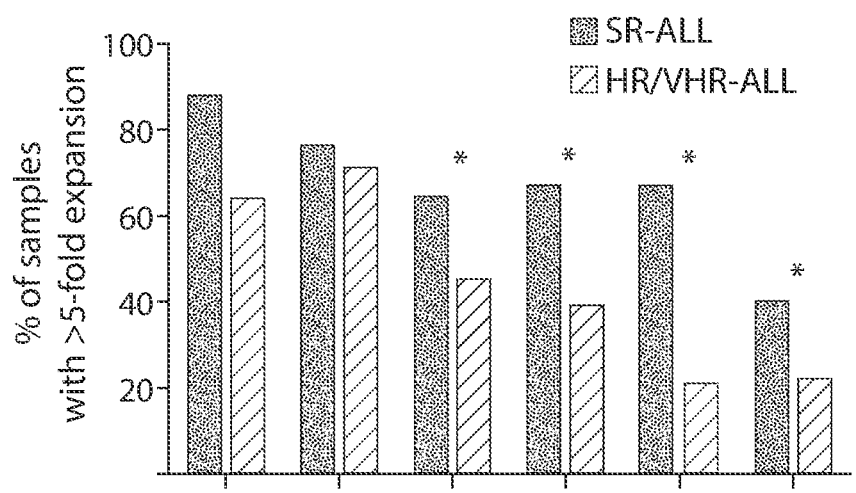
FIG. 22B is a bar graph showing the percentage of peripheral blood samples that passed test expansion from patients with SR-ALL and HR/VHR ALL.

Stratification of ALL samples into NCI SR and HR/VHR groups revealed that T cells from patients with SR-ALL demonstrated robust and maintained expansion capability, with an initial decline early in therapy and a modest decline during the maintenance phase (FIG. 22B). Although HR/VHR-ALL samples expanded well early in therapy, pass rates declined rapidly after consolidation phase (FIG. 22B), resulting in statistically significant differences in rate of passing test expansion when compared to SR-ALL (Table 12).

T Cell Counts

Figure 22C:
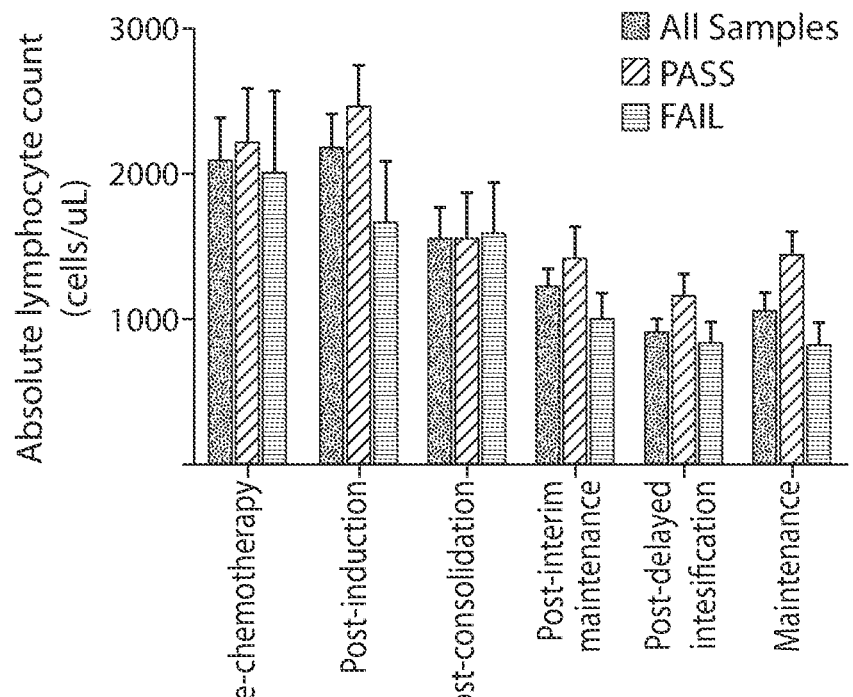
FIG. 22C is a bar graph showing the absolute lymphocyte counts from peripheral blood at various times of collection from all patients who expanded more (pass) or less than (fail) the 5-fold in vitro expansion threshold.
Figure 22D:
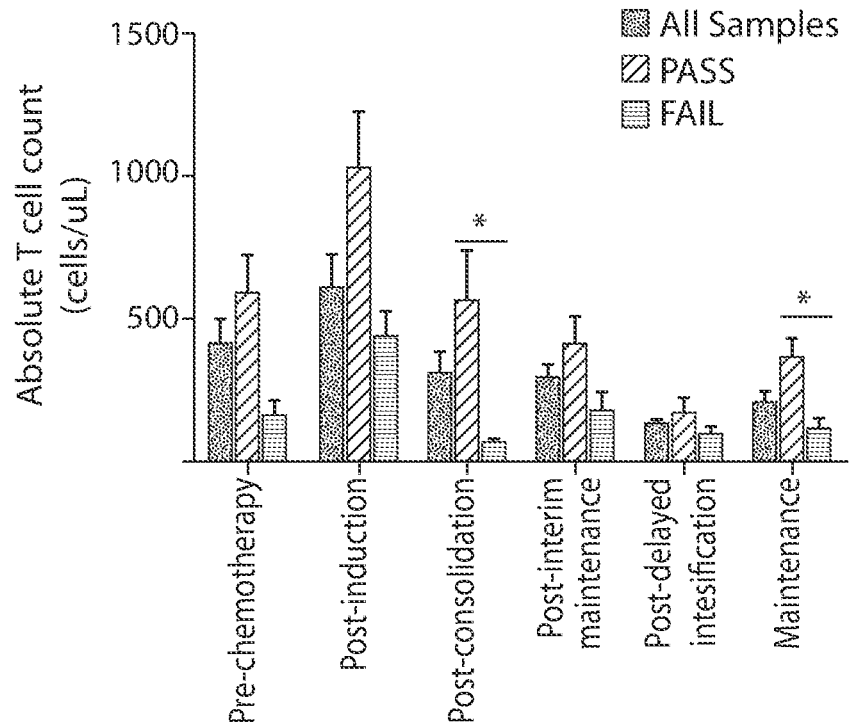
FIG. 22D is a bar graph showing absolute T cell counts from peripheral blood at various times of collection from all patients who passed or failed the 5-fold in vitro expansion threshold.
Figure 22E:
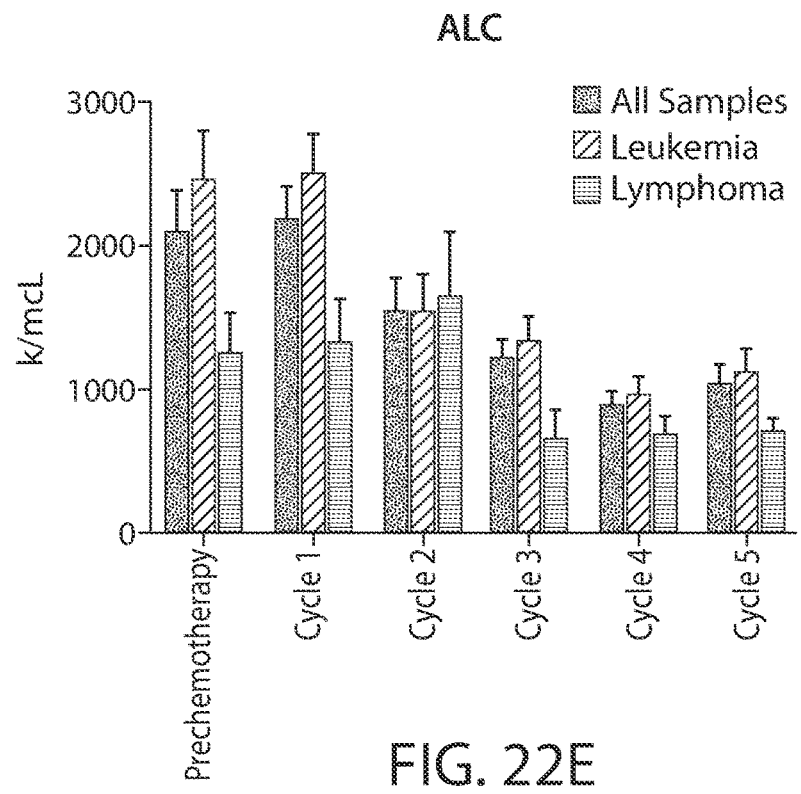
FIG. 22E is a bar graph showing absolute lymphocyte counts (in cells per microliter) from peripheral blood at various times of collection from all patients with leukemia or lymphoma.
Figure 22F:
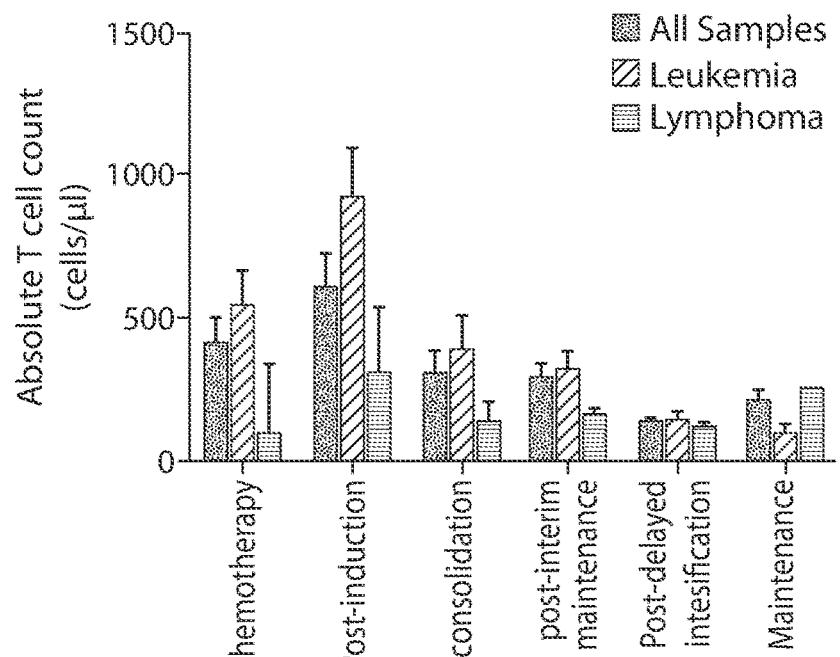
FIG. 22F is a bar graph showing absolute T cell counts (in cells per microliter) from peripheral blood at various times of collection from patients with leukemia or lymphoma. Significant differences are denoted with an "*" above each column and represent P<0.05. Statistical analysis can be found in Table 12.
Figure 24:
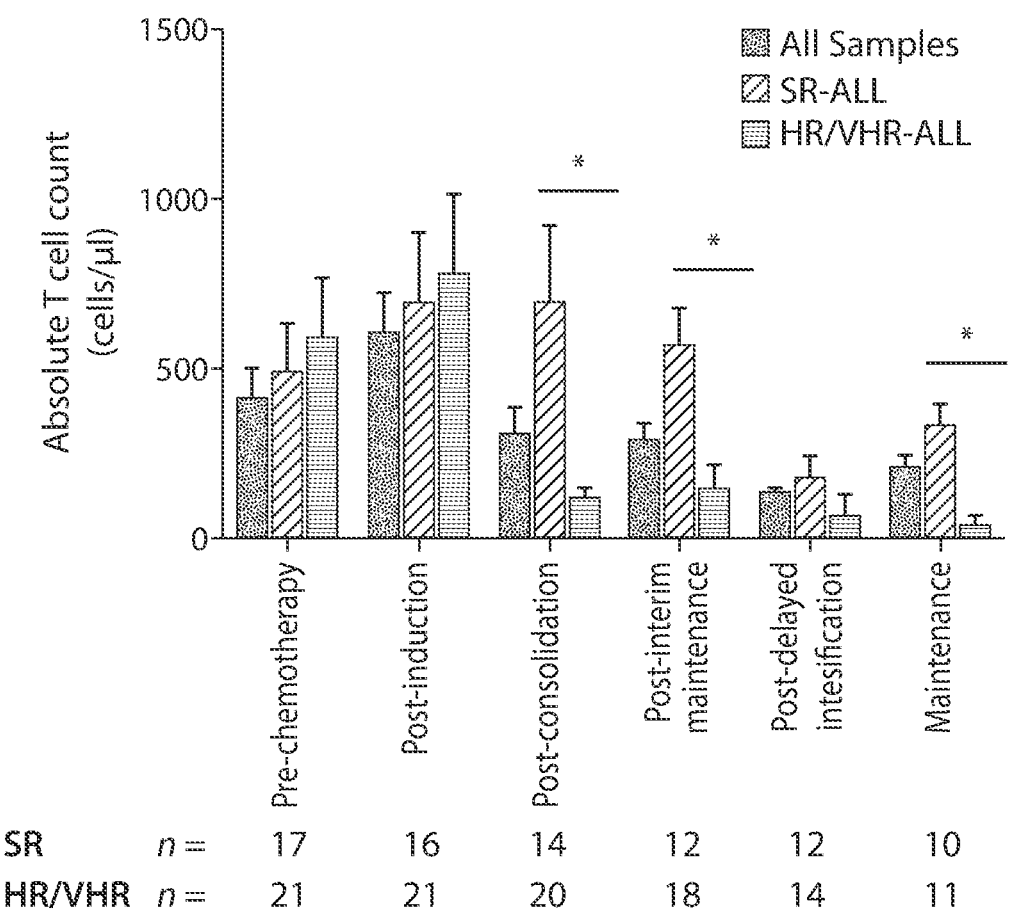
FIG. 24 is a bar graph showing the absolute T cell counts (in cells per microliter) from peripheral blood at various times of collection from all patients with SR- or HR/VHR- ALL. Significant differences are denoted with an "*" above each column and represent P<0.05. Statistical analysis can be found in Table 12.

Absolute lymphocyte counts (ALC) from peripheral blood at time of collection were higher early in therapy and declined after consolidation (FIGS. 22C and 22E). The absolute lymphocyte count was not different between leukemia and lymphoma patients, nor was it a predictor of T cell function. The relationship between ATC and expansion potential was investigated to evaluate whether this observed functional difference was simply a reflection of variability in T cell quantity. Absolute T cell counts from peripheral blood at time of collection from all patients who passed or failed the 5-fold in vitro expansion threshold generally were higher early in therapy (FIGS. 22D and 22F). ATC for leukemia samples declined after induction through maintenance therapy (FIG. 22F), demonstrating a similar trend as the expansion rates. Lymphoma samples at some time points had modest peripheral T cell counts (300 to 400 cells/ml); however, even during these cycles, T cells demonstrated poor expansion. Whereas leukemia samples demonstrated significantly greater expansion compared to lymphoma throughout therapy (FIG. 22A), no such statistical differences were observed in ATC between these two diseases. Examination of the risk group-stratified ALL samples demonstrated a progressive decline in SR-ALL ATC with a significant fall after delayed intensification (FIG. 24). This progressive decline in ATC correlated with the progressive decline in expansion (FIG. 22B). HR/VHR-ALL ATC experienced a sharp decline after consolidation therapy, correlating with the abrupt decline in expansion after consolidation (FIG. 22B). HR/VHR-ALL ATC remained low for the remainder of therapy, with expansion potential demonstrating a progressive decline. These findings suggest that in ALL, ATC may have some bearing on expansion potential; however, this association was not directly correlated at each cycle. For NHL, ATC seemed to have no bearing on expansion potential.

Early Lineage T Cells Associated with Enhanced Expression

Given that T cell quantity had no association with expansion in NHL and only a general correlation in ALL, the memory phenotypes present within these samples were evaluated as potential contributors to the observed functional differences. Cell lineages were defined by various cell surface marker patterns as described herein. The analysis was divided into three comparison groups, displayed at the top of each column in FIG. 23 (pass versus fail, FIG. 23A-23E; leukemia versus lymphoma, FIG. 23F-23J; SR-ALL versus HR/VHR-ALL, FIG. 23K-23O).

Figure 23A:
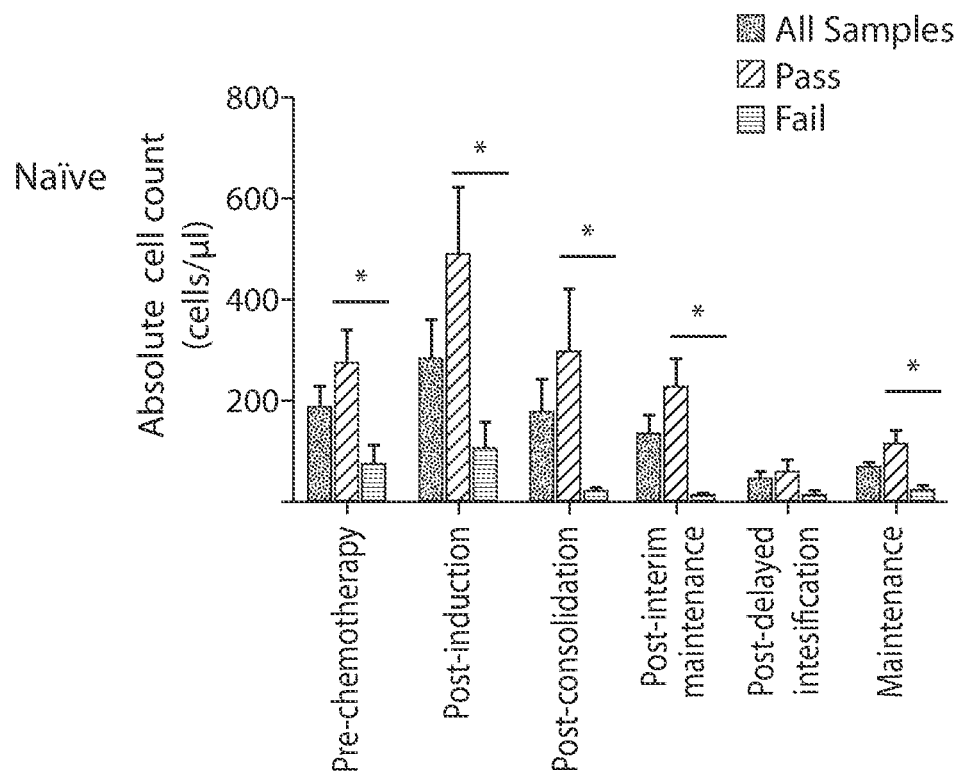
FIGS. 23A-23C are bar graphs showing memory phenotypes of T cells harvested from the peripheral blood of patients undergoing chemotherapy. Absolute cell counts are demonstrated from samples who passed and failed the greater than five-fold expansion threshold [column 1, FIG. 23A to FIG. 23E], patients with ALL or NHL [column 2, FIG. 23F to FIG. 23J], and patients with SR- and HR/VHR-ALL [column 3, FIG. 23K to FIG. 23O]. Significant differences are denoted with an "*" above each column and represent P<0.05. Statistical analysis can be found in Table 13, and a summary table can be found in Table 9.
Figure 23B:
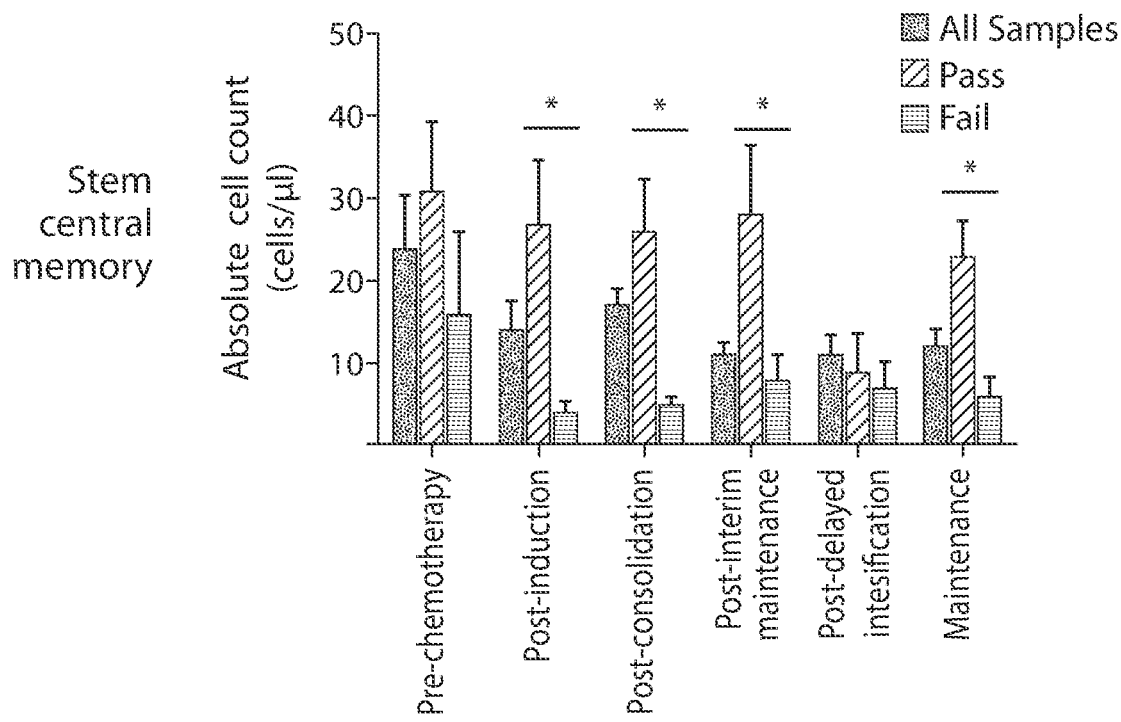
Figure 23C:
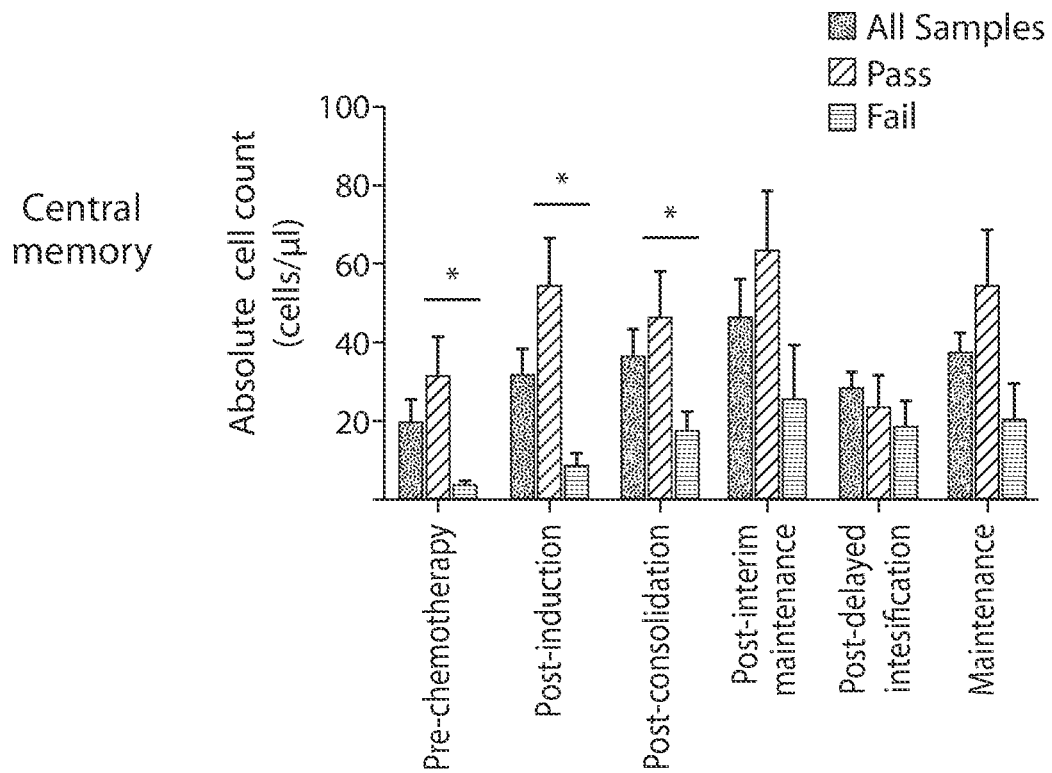
Figure 23D:
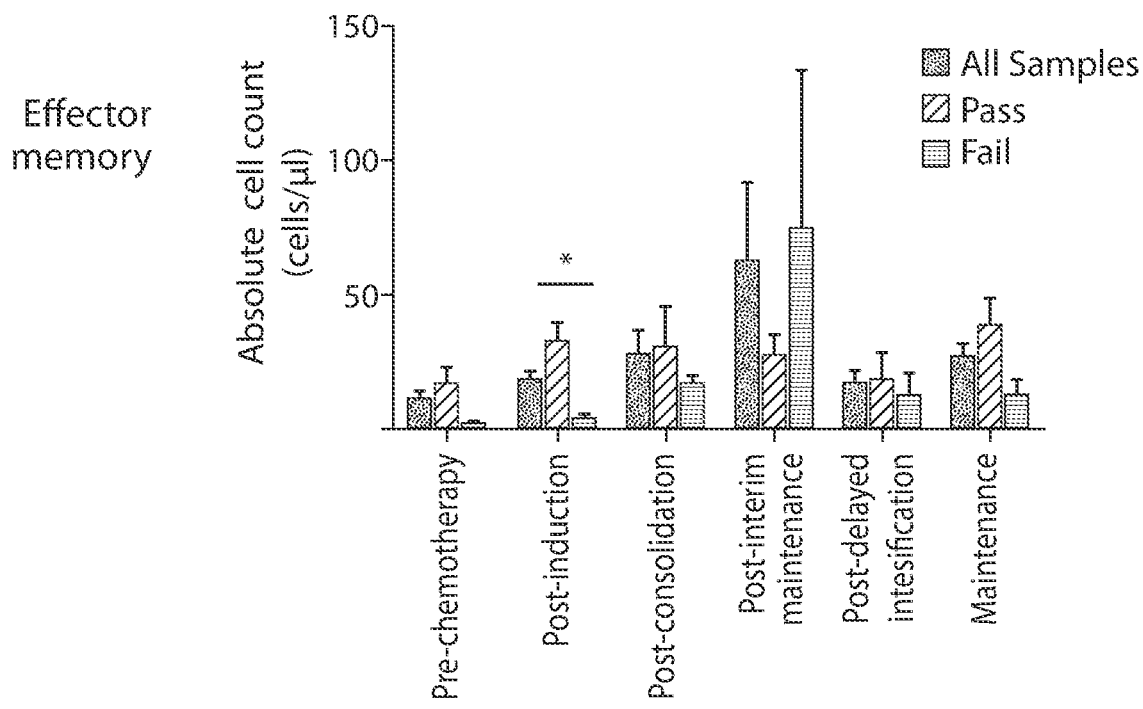
Figure 23E:
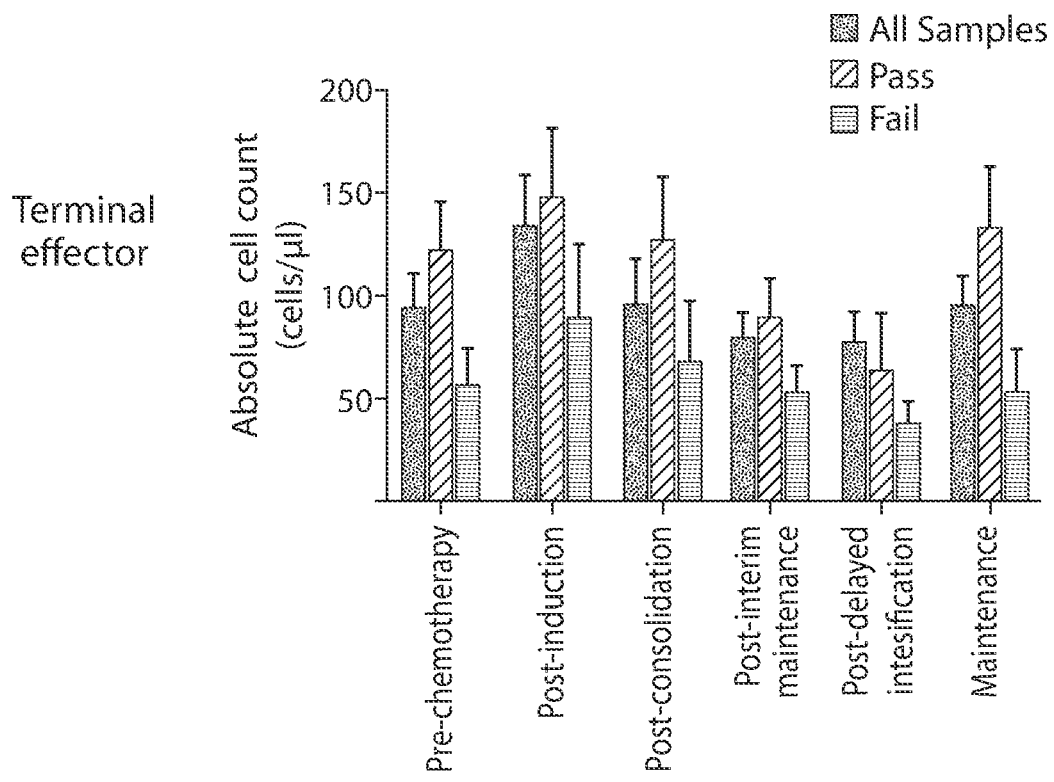
Figure 23F:
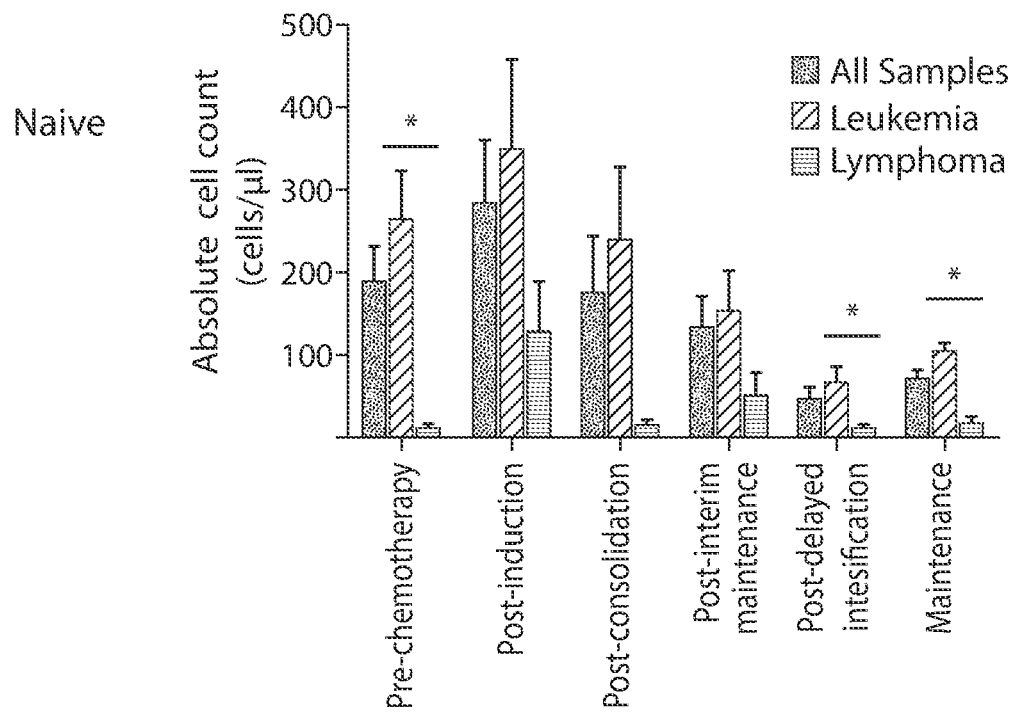
Figure 23G:
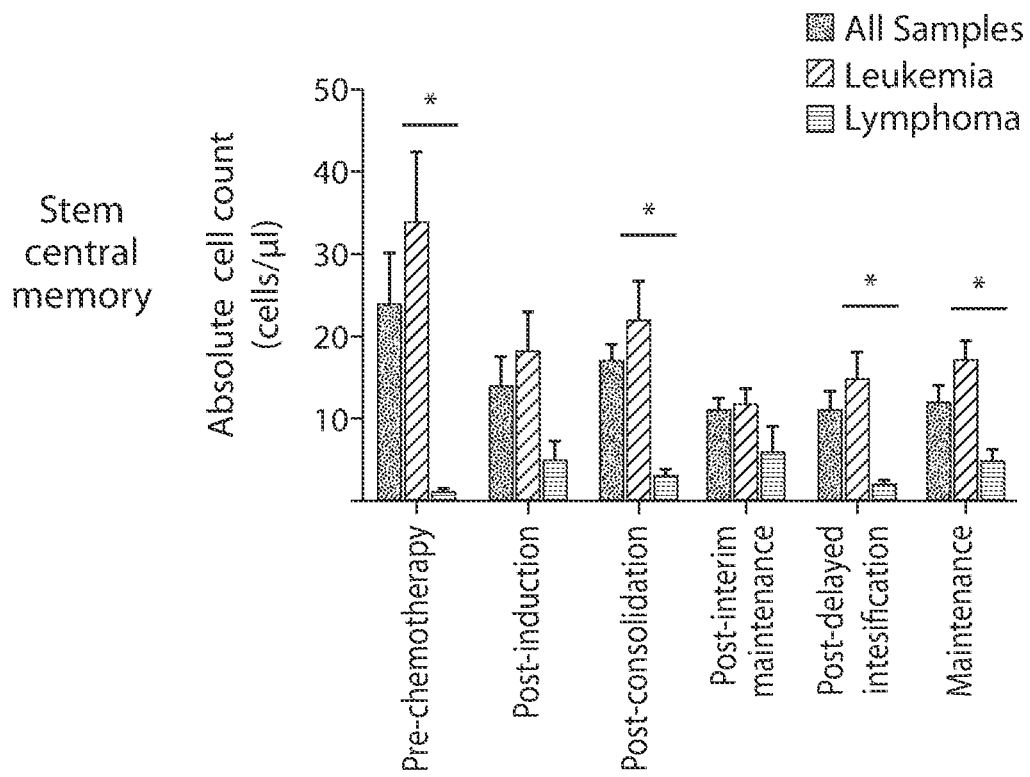
Figure 23H:
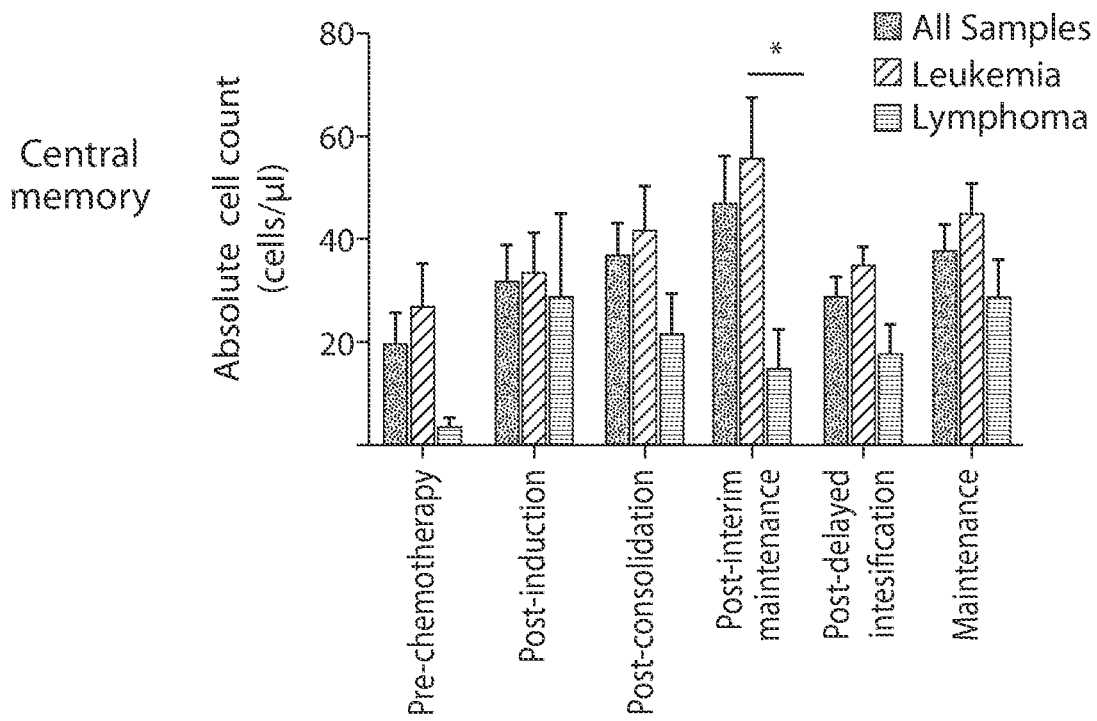
Figure 23I:
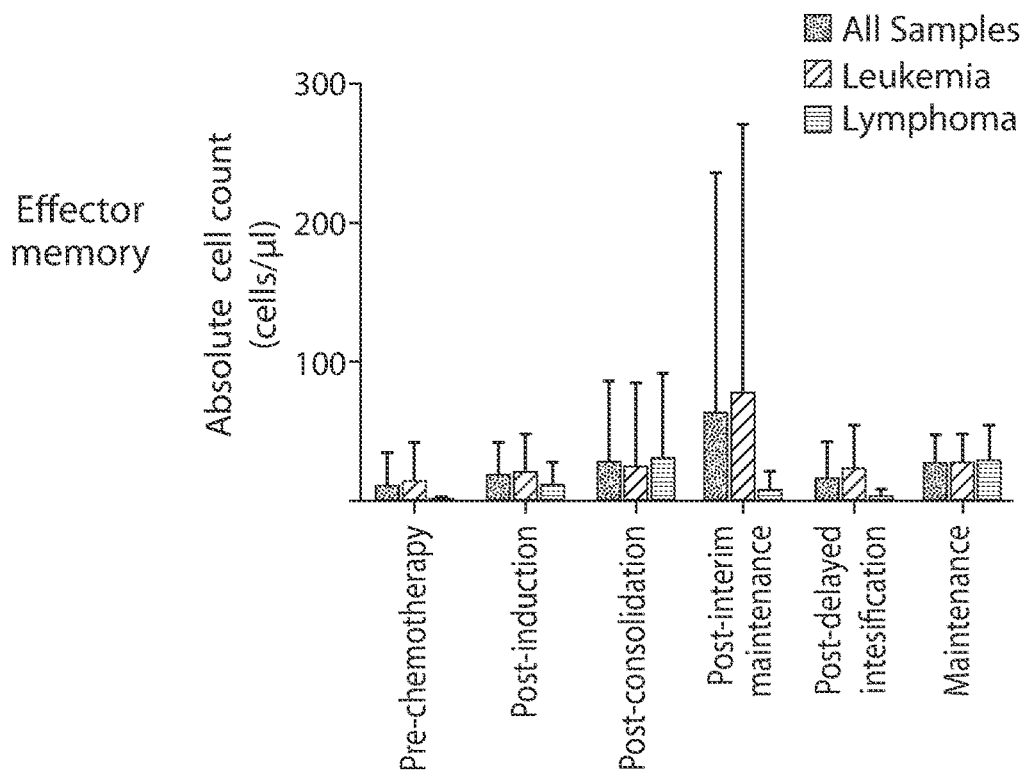
Figure 23J:
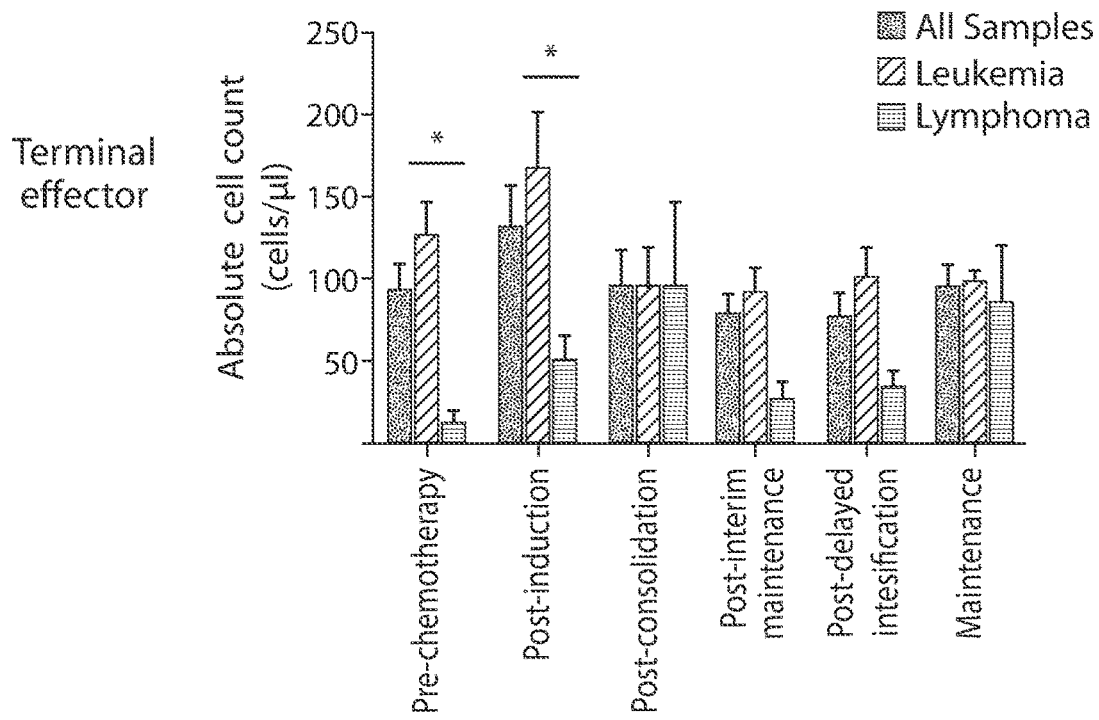

Comparison of samples that passed test expansion to those that did not (FIG. 23A-23E) revealed that successful expansion was associated with significant enrichment for TN cells at all time points except after delayed intensification, and enrichment of TSCM cells at all time points except diagnosis and after delayed intensification (FIG. 23A-23B). TN counts declined progressively through therapy in both passing and failing samples, whereas TSCM counts remained relatively stable. Passing samples were also enriched for TCM early in therapy (FIG. 23C) and TEM cells at a single time point (FIG. 23D); TEff counts were relatively equivalent in both groups (FIG. 23E). This overall pattern suggested that samples passing test expansion were significantly enriched for early lineage phenotypes as compared to those who failed after nearly every cycle of chemotherapy.

FIG. 23F-23J) reflects T cell phenotypes constituting the ATCs represented in FIG. 22F. There was a significant enrichment of TN cells in ALL samples at diagnosis, after delayed intensification and during maintenance, and a significant enrichment of TSCM cells after all cycles except after induction and interim maintenance. The lymphoma samples, in contrast, had low TN and TSCM counts throughout therapy, with a relative preservation of memory and effector phenotypes (FIG. 23H-23J), suggesting that the circulating T cell population in patients with lymphoma is composed predominantly of differentiated T cells with limited expansion potential and scarce early lineage subtypes even at diagnosis. ALL samples were enriched for early lineage cells, correlating to enhanced expansion throughout therapy.

Figure 23K:
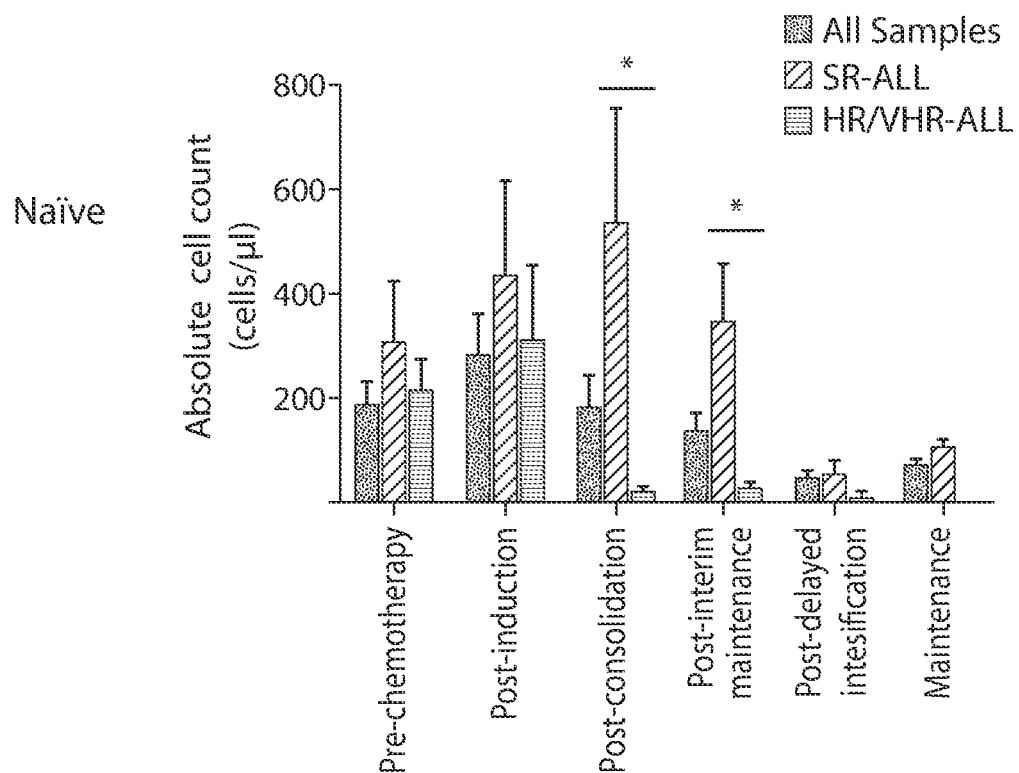
Figure 23L:
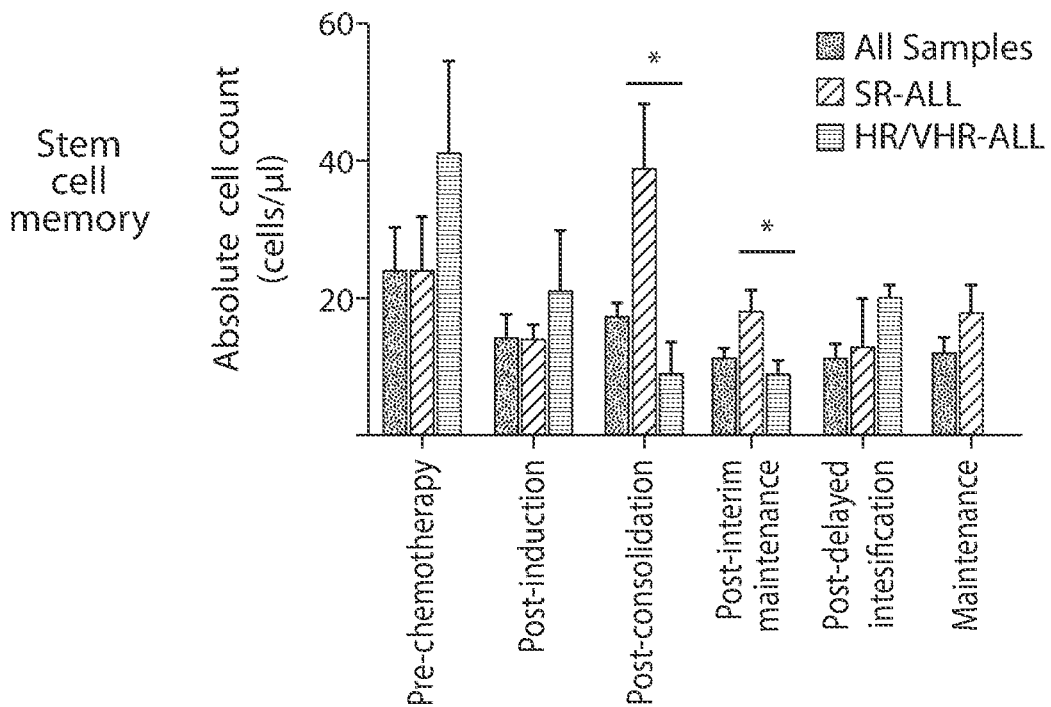
Figure 23M:
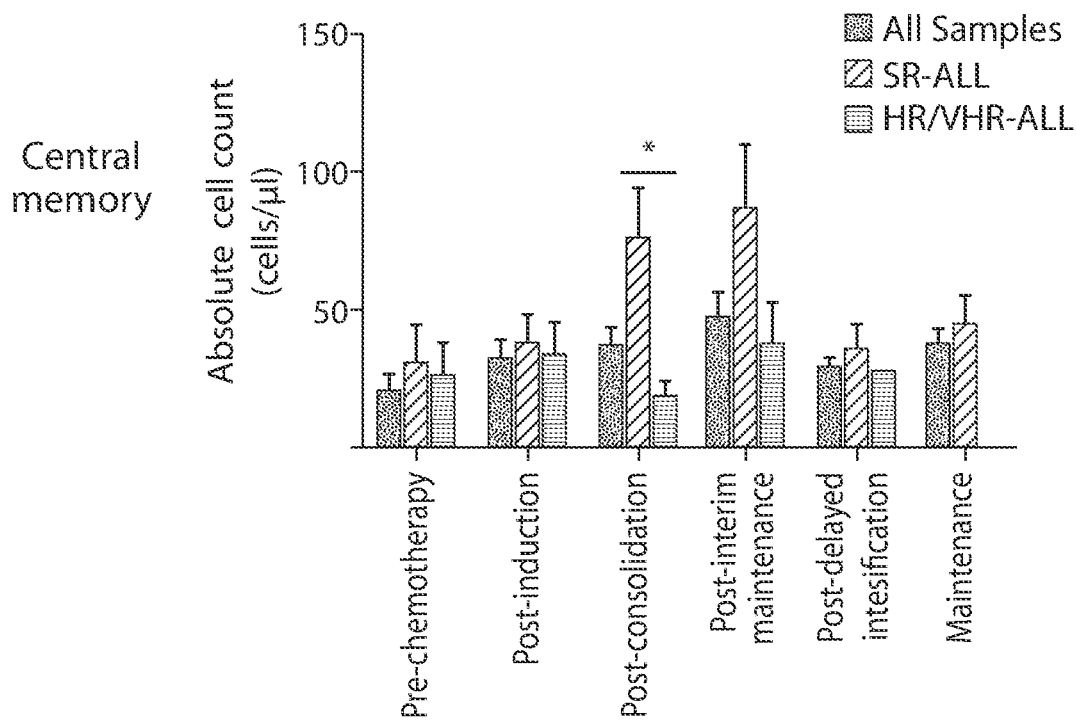
Figure 23N:
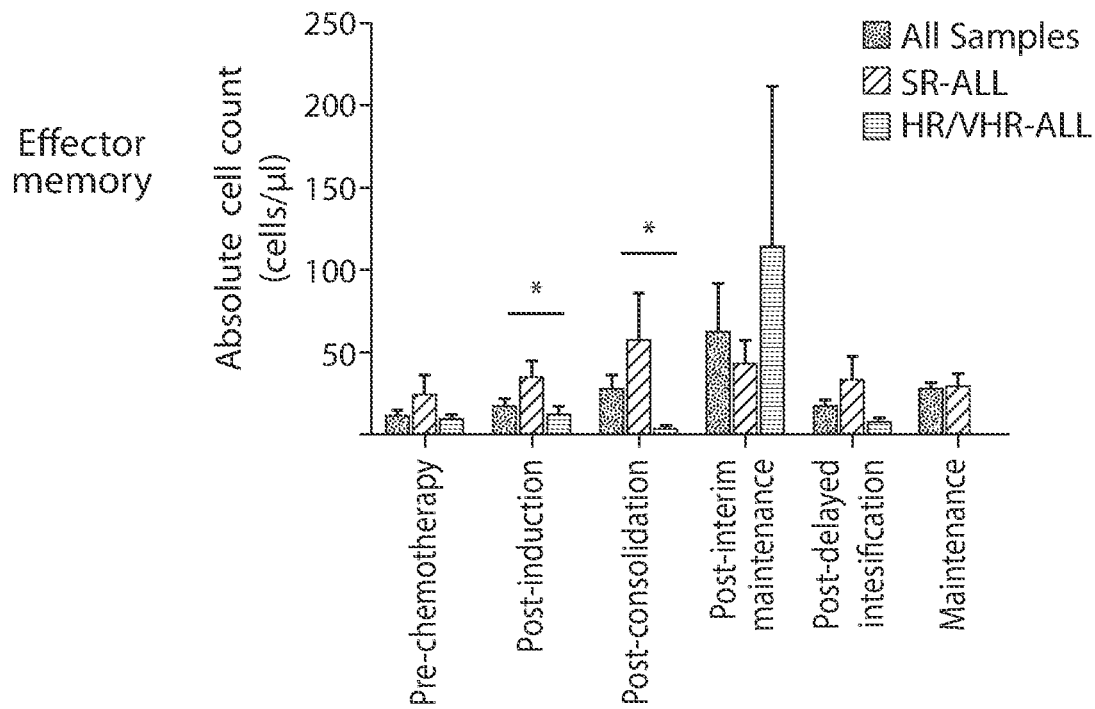

The analysis of samples from patients with ALL were divided into SR-ALL and HR/VHR-ALL. These phenotypic studies, now reflecting expansion and ATC data represented in FIGS. 22B and 24, respectively, demonstrated that in both populations, TN cells are elevated initially but demonstrated sharp declines during therapy; for SR-ALL, this decline occurred after delayed intensification, and for HR/VHR-ALL, this occurred after consolidation (FIG. 23K). This variation in timing of TN decline resulted in a significant difference in absolute TN counts after consolidation and after interim maintenance; this significance was lost when SR-ALL TN counts declined after delayed intensification. The timing of depletion of TN cell counts correlated directly to the timing of decline in ATC demonstrated in FIG. 24. TSCM cells, on the other hand, remained relatively stable in SR-ALL samples, although they progressively declined in HR/VHR-ALL samples (FIG. 23L). This decline again resulted in a significant difference after consolidation and interim maintenance that was lost after delayed intensification. FIG. 22B demonstrated a significant difference in expansion that also emerged (and was maintained) after consolidation, consistent with the differences observed in TN and TSCM cell counts, suggesting that depletion of these early lineage cells abrogated successful expansion. Examination of trends in later lineage cells revealed several additional observations. TCM counts remained relatively stable in SR-ALL samples and demonstrated a decline after delayed intensification in HR/VHR-ALL samples, but this decline was not maintained (FIG. 23M). TEM cell counts were low throughout therapy in both disease groups, with a high degree of variability (FIG. 23N). Finally, TEff cell counts demonstrated a progressive decline in SR-ALL samples but remained relatively stable in HR/VHR-ALL samples (FIG. 23O; for results of statistical analysis, see Table 13). The results from all three comparison groups are summarized in Table 9.

Both SR- and HR/VHR-ALL started with equivalent early lineage cell counts at diagnosis, and the pattern of depletion led to the examination of the chemotherapeutic regimens given. Two agents, cyclophosphamide and cytarabine, were given to each risk group at the times of the observed decline in TN cells; namely, SR-ALL patients received them during delayed intensification and HR/VHR-ALL patients received them with consolidation. These agents were not given at any other time for either treatment protocol, and no other agents were associated with this consistent and specific depletion.

TABLE 13

Figure 23O:
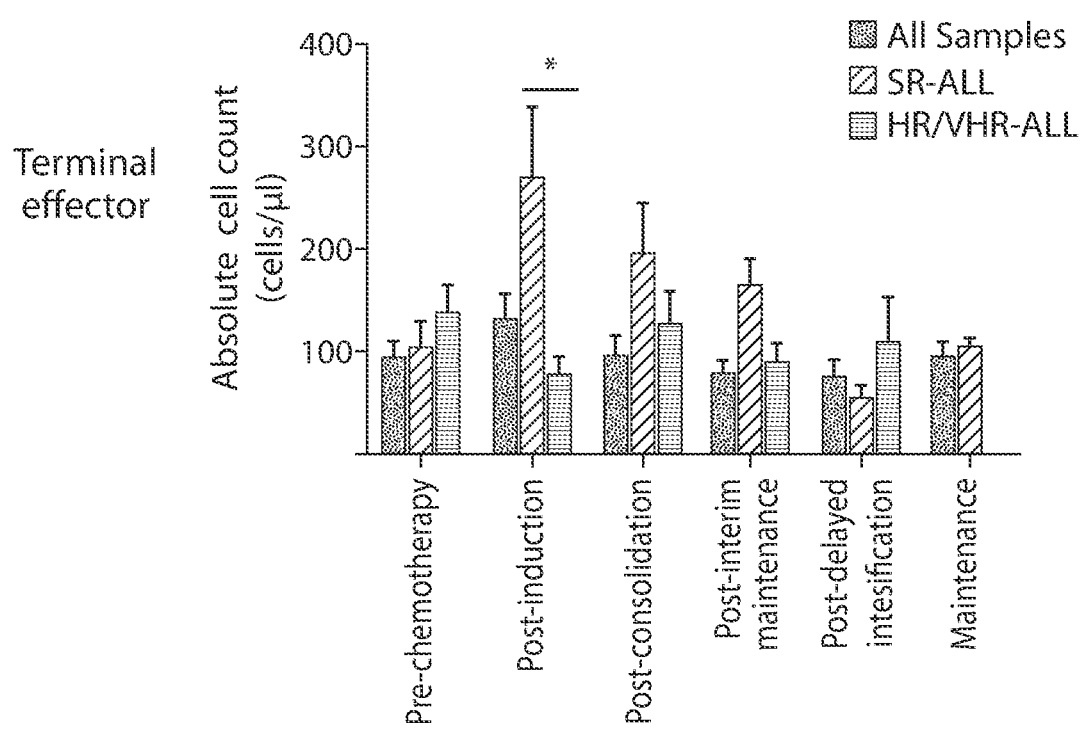

Statistical analysis of data presented in FIG. 23A-23O (all significant values underlined)

| | | Pre-chemo | Post-induction | Post-consolidation | Post-IM | Post-DI | Maintenance | |
|---|---|---|---|---|---|---|---|---|
| Pass v. Fail | 2A | 0.032 | 0.047 | 0.029 | 0.003 | 0.143 | 0.004 | Naive |
| | 2B | 0.278 | 0.040 | 0.003 | 0.046 | 0.730 | 0.003 | SCM |
| | 2C | 0.045 | 0.009 | 0.027 | 0.074 | 0.639 | 0.054 | CM |
| | 2D | 0.071 | 0.016 | 0.371 | 0.404 | 0.635 | 0.336 | EM |
| | 2E | 0.060 | 0.260 | 0.169 | 0.131 | 0.395 | 0.136 | TE |
| Leukemia v. Lymphoma | 2F | 0.010 | 0.215 | 0.124 | 0.173 | 0.044 | 0.0004 | Naive |
| | 2G | 0.020 | 0.124 | 0.021 | 0.079 | 0.006 | 0.0009 | SCM |
| | 2H | 0.108 | 0.755 | 0.178 | 0.035 | 0.061 | 0.117 | CM |
| | 2I | 0.093 | 0.303 | 0.770 | 0.222 | 0.074 | 0.916 | EM |
| | 2J | 0.0009 | 0.035 | 0.984 | 0.074 | 0.057 | 0.680 | TE |
| SR-ALL v. HR/VHR-ALL | 2K | 0.456 | 0.600 | 0.005 | 0.001 | 0.066 | 0.5 | Naive |
| | 2L | 0.355 | 0.527 | 0.004 | 0.025 | 0.386 | 0.423 | SCM |
| | 2M | 0.791 | 0.809 | 0.0009 | 0.076 | 0.415 | 0.512 | CM |
| | 2N | 0.200 | 0.041 | 0.014 | 0.600 | 0.114 | 0.5 | EM |
| | 2O | 0.438 | 0.004 | 0.228 | 0.055 | 0.205 | 0.56 | TE |

Enrichment of TSCM Cells Rescued Expansion

Enrichment of the TSCM population by addition of IL-7 and IL-15 cytokines has been thought to support less-mature T cell phenotypes. Given the association between early lineage cells and expansion, the effect of these cytokines on cell phenotype and expansion ability was evaluated. Samples were collected and split into two cultures, one with and one without cytokines. This analysis was stratified only by disease type, not by risk category or cycle of therapy. For reference, the analysis included the percentage of all samples passing test expansion for each disease group, which included all samples previously collected that were not part of the split-culture experiments (that is, samples analyzed in FIGS. 22A-22B, 22F, 24, and 23A-23O).

Figure 25A:
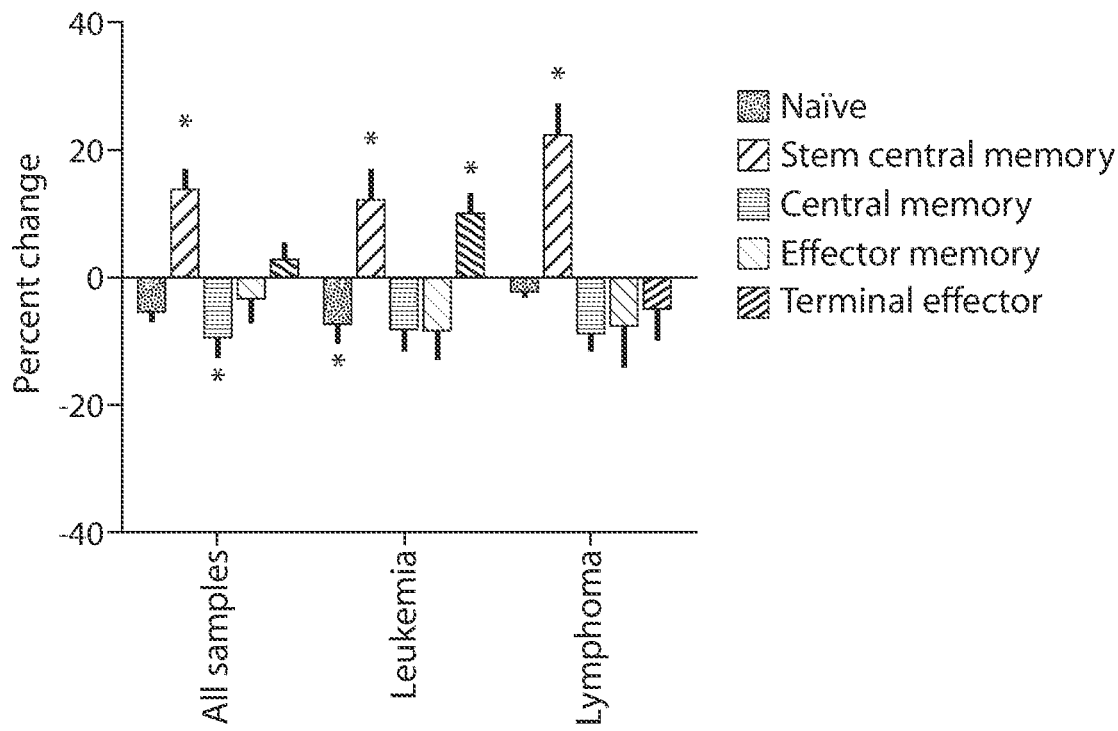
FIGS. 25A and 25B are bar graphs showing the effect of IL-7 and IL-15 on T cell phenotype and expansion. Collected samples were split into two stimulatory cultures, either with or without IL-7 and IL-15 as described in Example 4.
Figure 25B:
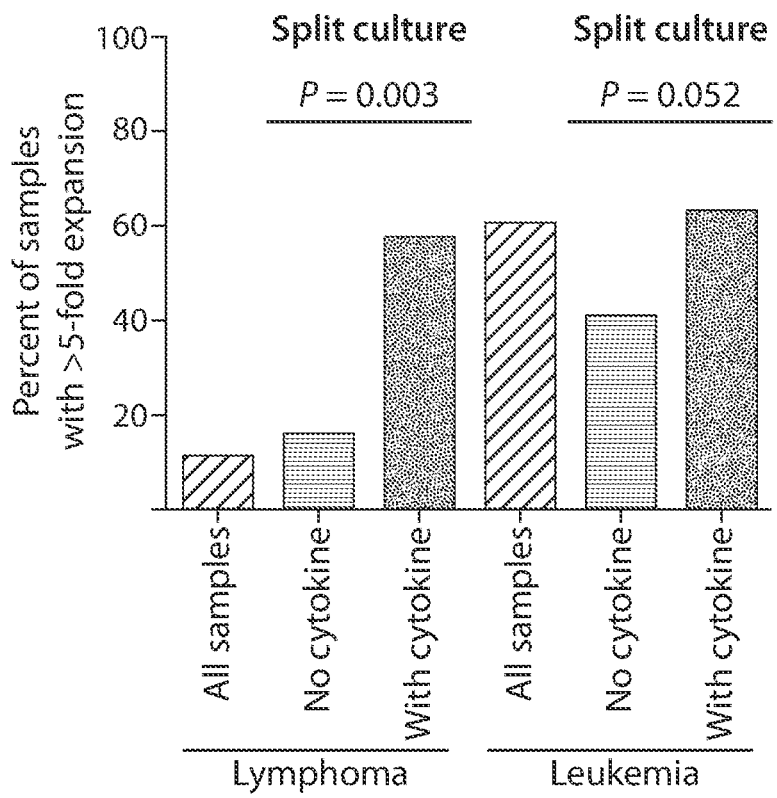

Samples collected from patients with both leukemia and lymphoma demonstrated a significant enrichment in TSCM populations after culture with IL-7 and IL-15 (FIG. 25A; for results of statistical analysis, see Table 14). This expansion of TSCM came at the expense of nearly every other cell type, with the exception of an increase in the TEff population in leukemia samples. This increase in TSCM cells was associated with enhanced expansion in both leukemia and lymphoma samples (FIG. 25B). Enhanced expansion was most pronounced in samples from patients with lymphoma, which demonstrated a statistically significant improvement (P=0.003), reflecting a 57.7% overall pass rate when enriched for TSCM cells and a 15.3% pass rate when cultured without cytokines. This pass rate approached that demonstrated by the leukemia samples (60.3%).

TABLE 14

Statistical analysis of data presented in FIG. 25A-25B—all significant values underlined

|  | All samples | Leukemia | Lymphoma |
|---|---|---|---|
| Naive | 0.12 | 0.012 | 0.455 |
| SCM | 0.009 | 0.023 | 0.001 |
| CM | 0.041 | 0.112 | 0.097 |
| EM | 0.275 | 0.179 | 0.172 |
| TE | 0.345 | 0.006 | 0.386 |

TABLE 9

Summary of significant differences in FIG. 23A-23O

|  |  | Naive | SCM | CM | EM | TE |
|---|---|---|---|---|---|---|
| Pass v. Fail | Pre-chemotherapy | * |  | * |  |  |
|  | Post-induction | * | * | * | * |  |
|  | Post-consolidation | * | * | * |  |  |
|  | Post-interim maintenance | * | * |  |  |  |
|  | Post-delayed intensification |  |  |  |  |  |
|  | Maintenance | * | * |  |  |  |
| ALL v. NHL | Pre-chemotherapy | * | * |  |  | * |
|  | Post-induction |  |  |  |  | * |
|  | Post-consolidation |  |  | * |  |  |
|  | Post-interim maintenance |  |  |  | * |  |
|  | Post-delayed intensification | * | * |  |  |  |
|  | Maintenance | * | * |  |  |  |
| SR-ALL v. HR/ VHR-ALL | Pre-chemotherapy |  |  |  |  |  |
|  | Post-induction |  |  |  | * | * |
|  | Post-consolidation | * | * | * | * |  |
|  | Post-interim maintenance | * | * |  |  |  |
|  | Post-delayed intensification |  |  |  |  |  |
|  | Maintenance |  |  |  |  |  |

(Stars represent statistically significant differences between the comparison groups, represented on the left.
SCM, stem central memory T cells;
CM, central memory T cells;
EM, effector memory T cells;
Teff, terminal effector T cells.)

CONCLUSIONS

The analysis of ALL was stratified into standard-risk (SR-ALL) and high/very-high-risk (HR/VHR-ALL) disease. SR-ALL samples maintained robust expansion until late in therapy, whereas HR/VHR samples demonstrated successful initial expansions that acutely declined in association with cyclophosphamide and cytarabine administration. Cyclophosphamide and cytarabine appeared to selectively deplete TN cells in both ALL risk groups, corresponding to the decline in HR/VHR-ALL T cell expansion. Culture with exogenous interleukin-7 (IL-7) and IL-15 during expansion significantly enhanced TSCM cell counts, and this enrichment significantly improved the expansion ability of lymphoma T cells.

Figure 26:
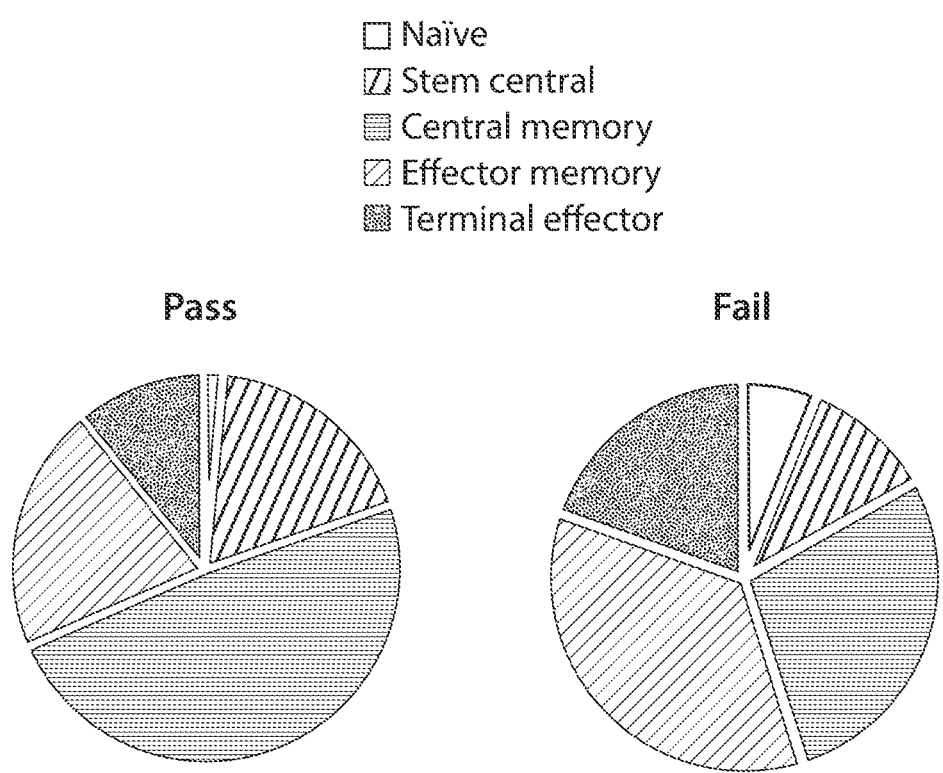
FIG. 26 is a set of pie charts showing post-expansion phenotypes of samples passing and failing test expansion. Phenotypes were assessed at the end of test expansion.

Patients with standard-risk ALL had improved T-cell expansion as compared to patients with high-risk or very high-risk ALL. Patients with lymphoma had poor T-cell expansion throughout therapy. Patients with T cell populations enriched for early lineage cells expanded better in vitro and that patients with ALL had higher numbers of these cells with a corresponding enhancement in expansion as compared to cells from patients with NHL. Examination of T cell phenotypes revealed that pateitns with ALL had enriched TN and TSCM cell subsets (early lineage cells), whereas those with lymphoma had very low early lineage cell counts. Also, larger naïve and stem central memory cell populations correlated with enhanced expansion capability. Naïve and stem central memory cells were depleted after delayed intensification in standard-risk ALL and were depleted earlier (after consolidation) in high and very-high risk ALL. Samples passing expansion produced a population of about 50% TCM, whereas those failing produced a cell product that was about 55% TEM and TEff, with a Teff pool twice as large as those passing (19.6% v. 10.5%). See FIG. 26. The TCM population present at the end of T cell expansion was derived primarily from TN and TSCM cells. Early lineage cells were selectively depleted by cyclophosphamide and cytarabine chemotherapy and that culture with interleukin-7 (IL-7) and IL-15 enriched select early lineage cells and rescued T cell expansion capability. Based on the results, cyclophosphamide and cytarabine were likely to be primarily responsible for depleting T cells with high proliferative capacity. Early lineage cells greatly aid T cell fitness for expansion, and enrichment of this population either by timing of T cell collection or culture method can increase the number of patients eligible to receive highly active engineered cellular therapies. Collection of T cells prior to cycles which include these agents increased the likelihood that these patients would be eligible for cell therapy. The results described herein provide ways to optimize expansion of therapeutic cells ex vivo and to enhance persistence of the cells (e.g., by T cell selection and support).

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (365 sequences)

SEQ ID NO: 1 - protein, 21 aa, Artificial Sequence
  source: /note="Description of Artificial Sequence: Synthetic peptide"
MALPVTALLLPLALLLHAARP

SEQ ID NO: 2 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 3 - DNA, 33 bp, Artificial Sequence
  source: /note="Description of Artificial Sequence: Synthetic primer"
ataggatcccagctggtggagtctgggggaggc

SEQ ID NO: 4 - DNA, 33 bp, Artificial Sequence
  source: /note="Description of Artificial Sequence: Synthetic primer"
atagctagcacctaggacggtcagcttggtccc

SEQ ID NO: 5 - protein, 1132 aa, Homo sapiens [sequence omitted]

SEQ ID NO: 6 - protein, 24 aa, Artificial Sequence
  source: /note="Description of Artificial Sequence: Synthetic peptide"
IYIWAPLAGTCGVLLLSLVITLYC

SEQ ID NO: 7 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 8 - DNA, 4027 bp, Homo sapiens
caggcagcgtggtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaa

SEQ ID NO: 9 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10 - protein, 112 aa, Artificial Sequence
  source: /note="Description of Artificial Sequence: Synthetic polypeptide"
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 12 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 13 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 14 - protein, 10 aa, Artificial Sequence
  source: /note="Description of Artificial Sequence: Synthetic peptide"
GGGGSGGGGS

SEQ ID NO: 15 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 16 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 17 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 18 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 19 - DNA, 30 bp, Artificial Sequence
  source: /note="Description of Artificial Sequence: Synthetic oligonucleotide"
ggtggcggaggttctggaggtggaggttcc

SEQ ID NO: 20 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 21 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - protein, 40 aa, Artificial Sequence
  source: /note="Description of Artificial Sequence: Synthetic polypeptide"
  MISC_FEATURE (1)..(40): /note="This sequence may encompass 1-10 'Gly Gly Gly Ser' repeating units, wherein some positions may be absent"
  source: /note="See specification as filed for detailed description of substitutions and preferred embodiments"
GGGSGGGSGGGSGGGSGGGSGGGSGGGSGGGSGGGSGGGS

SEQ ID NO: 23 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 24 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 25 - protein, 5 aa, Artificial Sequence
  source: /note="Description of Artificial Sequence: Synthetic peptide"
GGGGS

SEQ ID NO: 26 - protein, 5 aa, Artificial Sequence
  source: /note="Description of Artificial Sequence: Synthetic peptide"
GGGGS

SEQ ID NO: 27 - protein, 20 aa, Artificial Sequence
  source: /note="Description of Artificial Sequence: Synthetic peptide"
GGGGSGGGGSGGGGSGGGGS

SEQ ID NO: 28 - protein, 15 aa, Artificial Sequence
  source: /note="Description of Artificial Sequence: Synthetic peptide"
GGGGSGGGGSGGGGS

SEQ ID NO: 29 - protein, 4 aa, Artificial Sequence
  source: /note="Description of Artificial Sequence: Synthetic peptide"
GGGS

SEQ ID NO: 30 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 31 - DNA, 100 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttt

SEQ ID NO: 32 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 33 - DNA, 5000 bp, Artificial Sequence; identical to SEQ ID NO: 30
  source: /note="Description of Artificial Sequence: Synthetic polynucleotide"

SEQ ID NO: 34 - DNA, 400 bp, Artificial Sequence
  source: /note="Description of Artificial Sequence: Synthetic polynucleotide"
  misc_feature (1)..(400): /note="This sequence may encompass 100-400 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 2000 bp, Artificial Sequence
  source: /note="Description of Artificial Sequence: Synthetic polynucleotide"
  misc_feature (1)..(2000): /note="This sequence may encompass 50-2000 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 36 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 37 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 38 - protein, 40 aa, Artificial Sequence; identical to SEQ ID NO: 22
  source: /note="Description of Artificial Sequence: Synthetic polypeptide"
  MISC_FEATURE (1)..(40): /note="This sequence may encompass 1-10 'Gly Gly Gly Ser' repeating units, wherein some positions may be absent"
  source: /note="See specification as filed for detailed description of substitutions and preferred embodiments"

SEQ ID NO: 39 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 40 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 41 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 42 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 43 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 44 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 45 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 46 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 47 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 48 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 49 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 50 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 51 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 52 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 53 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 54 - DNA, 813 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 55 - DNA, 813 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 56 - DNA, 828 bp, Artificial Sequence
  source: /note="Description of Artificial Sequence: Synthetic polynucleotide"
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactactcttcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 57 - DNA, 828 bp, Artificial Sequence
  source: /note="Description of Artificial Sequence: Synthetic polynucleotide"
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactaccagtcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 58 - DNA, 828 bp, Artificial Sequence
  source: /note="Description of Artificial Sequence: Synthetic polynucleotide"
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactactcatcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 59 - DNA, 828 bp, Artificial Sequence
  source: /note="Description of Artificial Sequence: Synthetic polynucleotide"
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactaccagtcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcatcaccac

SEQ ID NO: 60 - DNA, 828 bp, Artificial Sequence
  source: /note="Description of Artificial Sequence: Synthetic polynucleotide"
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactacaattcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 61 - DNA, 828 bp, Artificial Sequence
  source: /note="Description of Artificial Sequence: Synthetic polynucleotide"
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactacaactcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 62 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaattcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 63 - DNA, 813 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 64 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 65 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 66 - protein, 271 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 67 - protein, 271 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 68 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 69 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 70 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 71 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 72 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 73 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 74 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 75 - protein, 271 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 76 - protein, 271 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSHHHHHHHH

SEQ ID NO: 77 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 78 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 79 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 80 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 81 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 82 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 83 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 84 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 85 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 86 - protein, 491 aa, Artificial Sequence; identical to SEQ ID NO: 85
  source: /note="Description of Artificial Sequence: Synthetic polypeptide"

SEQ ID NO: 87 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 88 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 89 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 90 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 91 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 92 - DNA, 1458 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 93 - DNA, 1458 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 94 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggcggaggcgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 95 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggagggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 96 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 97 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggcggtgggtcagaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 98 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggtgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 99 - DNA, 1473 bp, Artificial Sequence; identical to SEQ ID NO: 98
  source: /note="Description of Artificial Sequence: Synthetic polynucleotide"

SEQ ID NO: 100 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 101 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 102 - DNA, 1458 bp, Artificial Sequence
  source: /note="Description of Artificial Sequence: Synthetic polynucleotide"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 103 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 104 - protein, 18 aa, Artificial Sequence
  source: /note="Description of Artificial Sequence: Synthetic peptide"
GSTSGSGKPGSGEGSTKG

SEQ ID NO: 105 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 106 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 107 - protein, 242 aa, Artificial Sequence; identical to SEQ ID NO: 39
  source: /note="Description of Artificial Sequence: Synthetic polypeptide"

SEQ ID NO: 108 - protein, 242 aa, Artificial Sequence; identical to SEQ ID NO: 40
  source: /note="Description of Artificial Sequence: Synthetic polypeptide"

SEQ ID NO: 109 - protein, 242 aa, Artificial Sequence; identical to SEQ ID NO: 41
  source: /note="Description of Artificial Sequence: Synthetic polypeptide"

SEQ ID NO: 110 - protein, 242 aa, Artificial Sequence; identical to SEQ ID NO: 42
  source: /note="Description of Artificial Sequence: Synthetic polypeptide"

SEQ ID NO: 111 - protein, 247 aa, Artificial Sequence; identical to SEQ ID NO: 43
  source: /note="Description of Artificial Sequence: Synthetic polypeptide"

SEQ ID NO: 112 - protein, 247 aa, Artificial Sequence; identical to SEQ ID NO: 44
  source: /note="Description of Artificial Sequence: Synthetic polypeptide"

SEQ ID NO: 113 - protein, 247 aa, Artificial Sequence; identical to SEQ ID NO: 45
  source: /note="Description of Artificial Sequence: Synthetic polypeptide"

SEQ ID NO: 114 - protein, 247 aa, Artificial Sequence; identical to SEQ ID NO: 46
  source: /note="Description of Artificial Sequence: Synthetic polypeptide"

SEQ ID NO: 115 - protein, 247 aa, Artificial Sequence; identical to SEQ ID NO: 47
  source: /note="Description of Artificial Sequence: Synthetic polypeptide"

SEQ ID NO: 116 - protein, 247 aa, Artificial Sequence; identical to SEQ ID NO: 48
  source: /note="Description of Artificial Sequence: Synthetic polypeptide"

SEQ ID NO: 117 - protein, 242 aa, Artificial Sequence; identical to SEQ ID NO: 49
  source: /note="Description of Artificial Sequence: Synthetic polypeptide"

SEQ ID NO: 118 - protein, 242 aa, Artificial Sequence; identical to SEQ ID NO: 50
  source: /note="Description of Artificial Sequence: Synthetic polypeptide"

SEQ ID NO: 119 - protein, 242 aa, Artificial Sequence; identical to SEQ ID NO: 51
  source: /note="Description of Artificial Sequence: Synthetic polypeptide"

SEQ ID NO: 120 - protein, 119 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 121 - protein, 111 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 122 - protein, 10 aa, Artificial Sequence
  source: /note="Description of Artificial Sequence: Synthetic peptide"
GVSLPDYGVS

SEQ ID NO: 123 - protein, 16 aa, Artificial Sequence
  source: /note="Description of Artificial Sequence: Synthetic peptide"
VIWGSETTYYNSALKS

SEQ ID NO: 124 - protein, 16 aa, Artificial Sequence
  source: /note="Description of Artificial Sequence: Synthetic peptide"
VIWGSETTYYSSSLKS

SEQ ID NO: 125 - protein, 16 aa, Artificial Sequence
  source: /note="Description of Artificial Sequence: Synthetic peptide"
VIWGSETTYYQSSLKS

SEQ ID NO: 126 - protein, 16 aa, Artificial Sequence
  source: /note="Description of Artificial Sequence: Synthetic peptide"
VIWGSETTYYNSSLKS

SEQ ID NO: 127 - protein, 12 aa, Artificial Sequence
  source: /note="Description of Artificial Sequence: Synthetic peptide"
HYYYGGSYAMDY

SEQ ID NO: 128 - protein, 11 aa, Artificial Sequence
  source: /note="Description of Artificial Sequence: Synthetic peptide"
RASQDISKYLN

SEQ ID NO: 129 - protein, 7 aa, Artificial Sequence
  source: /note="Description of Artificial Sequence: Synthetic peptide"
HTSRLHS

SEQ ID NO: 130 - protein, 9 aa, Artificial Sequence
  source: /note="Description of Artificial Sequence: Synthetic peptide"
QQGNTLPYT

SEQ ID NO: 131 - protein, 132 aa, Artificial Sequence
  source: /note="Description of Artificial Sequence: Synthetic polypeptide"
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 132 - protein, 108 aa, Artificial Sequence
  source: /note="Description of Artificial Sequence: Synthetic polypeptide"
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 133 - protein, 93 aa, Artificial Sequence [sequence omitted]

SEQ ID NO: 134 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 135 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 136 - protein, 95 aa, Artificial Sequence
  source: /note="Description of Artificial Sequence: Synthetic polypeptide"
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 137 - protein, 95 aa, Artificial Sequence
  source: /note="Description of Artificial Sequence: Synthetic polypeptide"
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 138 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 139 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 140 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 141 - DNA, 738 bp, Artificial Sequence
  source: /note="Description of Artificial Sequence: Synthetic polynucleotide"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 142 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 143 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 144 - protein, 490 aa, Artificial Sequence
  source: /note="Description of Artificial Sequence: Synthetic polypeptide"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 145 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 146 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 147 - DNA, 732 bp, Artificial Sequence
  source: /note="Description of Artificial Sequence: Synthetic polynucleotide"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 148 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 149 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 150 - protein, 488 aa, Artificial Sequence
  source: /note="Description of Artificial Sequence: Synthetic polypeptide"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 151 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 152 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 153 - DNA, 729 bp, Artificial Sequence
  source: /note="Description of Artificial Sequence: Synthetic polynucleotide"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 154 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 155 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 156 - protein, 487 aa, Artificial Sequence
  source: /note="Description of Artificial Sequence: Synthetic polypeptide"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 157 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 158 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 159 - DNA, 747 bp, Artificial Sequence
  source: /note="Description of Artificial Sequence: Synthetic polynucleotide"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 160 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 161 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 162 - protein, 493 aa, Artificial Sequence
  source: /note="Description of Artificial Sequence: Synthetic polypeptide"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 163 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 164 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 165 - DNA, 738 bp, Artificial Sequence
  source: /note="Description of Artificial Sequence: Synthetic polynucleotide"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 166 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 167 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 168 - protein, 490 aa, Artificial Sequence
  source: /note="Description of Artificial Sequence: Synthetic polypeptide"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 169 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 170 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 171 - DNA, 741 bp, Artificial Sequence
  source: /note="Description of Artificial Sequence: Synthetic polynucleotide"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 172 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 173 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 174 - protein, 491 aa, Artificial Sequence
  source: /note="Description of Artificial Sequence: Synthetic polypeptide"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 175 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 176 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 177 - DNA, 714 bp, Artificial Sequence
  source: /note="Description of Artificial Sequence: Synthetic polynucleotide"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 178 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 179 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 180 - protein, 482 aa, Artificial Sequence
  source: /note="Description of Artificial Sequence: Synthetic polypeptide"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 181 - DNA, 1446 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 182 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 183 - DNA, 717 bp, Artificial Sequence
  source: /note="Description of Artificial Sequence: Synthetic polynucleotide"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 184 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 185 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 186 - protein, 483 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 187 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 188 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 189 - DNA, 723 bp, Artificial Sequence
  source: /note="Description of Artificial Sequence: Synthetic polynucleotide"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 190 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 191 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 192 - protein, 485 aa, Artificial Sequence
  source: /note="Description of Artificial Sequence: Synthetic polypeptide"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 193 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 194 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 195 - DNA, 717 bp, Artificial Sequence
  source: /note="Description of Artificial Sequence: Synthetic polynucleotide"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 196 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 197 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 198 - protein, 483 aa, Artificial Sequence
  source: /note="Description of Artificial Sequence: Synthetic polypeptide"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 199 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 200 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 201 - DNA, 717 bp, Artificial Sequence
  source: /note="Description of Artificial Sequence: Synthetic polynucleotide"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 202 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 203 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 204 - protein, 483 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 205 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 206 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 207 - DNA, 738 bp, Artificial Sequence
  source: /note="Description of Artificial Sequence: Synthetic polynucleotide"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 208 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 209 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 210 - protein, 490 aa, Artificial Sequence
  source: /note="Description of Artificial Sequence: Synthetic polypeptide"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 212 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 213 - DNA, 717 bp, Artificial Sequence
  source: /note="Description of Artificial Sequence: Synthetic polynucleotide"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 214 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 215 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 216 - protein, 483 aa, Artificial Sequence
  source: /note="Description of Artificial Sequence: Synthetic polypeptide"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 218 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 219 - DNA, 720 bp, Artificial Sequence
  source: /note="Description of Artificial Sequence: Synthetic polynucleotide"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 220 - protein, 115 aa, Artificial Sequence; identical to SEQ ID NO: 184
  source: /note="Description of Artificial Sequence: Synthetic polypeptide"

SEQ ID NO: 221 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 222 - protein, 484 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 223 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 224 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 225 - DNA, 723 bp, Artificial Sequence
  source: /note="Description of Artificial Sequence: Synthetic polynucleotide"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 226 - protein, 115 aa, Artificial Sequence; identical to SEQ ID NO: 202
  source: /note="Description of Artificial Sequence: Synthetic polypeptide"

SEQ ID NO: 227 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 228 - protein, 485 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 229 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 230 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 231 - DNA, 729 bp, Artificial Sequence
  source: /note="Description of Artificial Sequence: Synthetic polynucleotide"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 232 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 233 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 234 - protein, 487 aa, Artificial Sequence
  source: /note="Description of Artificial Sequence: Synthetic polypeptide"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 235 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 236 - protein, 244 aa, Artificial Sequence
  source: /note="Description of Artificial Sequence: Synthetic polypeptide"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 237 - DNA, 735 bp, Artificial Sequence
  source: /note="Description of Artificial Sequence: Synthetic polynucleotide"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 238 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 239 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 240 - protein, 489 aa, Artificial Sequence
  source: /note="Description of Artificial Sequence: Synthetic polypeptide"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 241 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 242 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 243 - DNA, 738 bp, Artificial Sequence
  source: /note="Description of Artificial Sequence: Synthetic polynucleotide"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 244 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 245 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 246 - protein, 490 aa, Artificial Sequence
  source: /note="Description of Artificial Sequence: Synthetic polypeptide"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 247 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 248 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 249 - DNA, 720 bp, Artificial Sequence
  source: /note="Description of Artificial Sequence: Synthetic polynucleotide"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 250 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 251 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 252 - protein, 484 aa, Artificial Sequence
  source: /note="Description of Artificial Sequence: Synthetic polypeptide"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 253 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 254 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 255 - DNA, 723 bp, Artificial Sequence
  source: /note="Description of Artificial Sequence: Synthetic polynucleotide"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 256 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 257 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 258 - protein, 485 aa, Artificial Sequence
  source: /note="Description of Artificial Sequence: Synthetic polypeptide"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 260 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 261 - DNA, 735 bp, Artificial Sequence
  source: /note="Description of Artificial Sequence: Synthetic polynucleotide"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 262 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 263 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 264 - protein, 489 aa, Artificial Sequence
  source: /note="Description of Artificial Sequence: Synthetic polypeptide"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 265 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 266 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 267 - DNA, 759 bp, Artificial Sequence
  source: /note="Description of Artificial Sequence: Synthetic polynucleotide"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 268 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 269 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 270 - protein, 497 aa, Artificial Sequence
  source: /note="Description of Artificial Sequence: Synthetic polypeptide"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - DNA, 1491 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 272 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 273 - DNA, 744 bp, Artificial Sequence
  source: /note="Description of Artificial Sequence: Synthetic polynucleotide"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 274 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 275 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 276 - protein, 492 aa, Artificial Sequence
  source: /note="Description of Artificial Sequence: Synthetic polypeptide"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 277 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 278 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 279 - DNA, 738 bp, Artificial Sequence
  source: /note="Description of Artificial Sequence: Synthetic polynucleotide"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 280 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 281 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 282 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 283 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 284 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 285 - DNA, 723 bp, Artificial Sequence
  source: /note="Description of Artificial Sequence: Synthetic polynucleotide"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 286 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 287 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 288 - protein, 485 aa, Artificial Sequence
  source: /note="Description of Artificial Sequence: Synthetic polypeptide"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 289 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 290 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 291 - DNA, 744 bp, Artificial Sequence
  source: /note="Description of Artificial Sequence: Synthetic polynucleotide"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 292 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 293 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 294 - protein, 492 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 295 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 296 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 297 - DNA, 744 bp, Artificial Sequence
  source: /note="Description of Artificial Sequence: Synthetic polynucleotide"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 298 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 299 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 300 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 301 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 302 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 303 - DNA, 717 bp, Artificial Sequence
  source: /note="Description of Artificial Sequence: Synthetic polynucleotide"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 304 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 305 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 306 - protein, 483 aa, Artificial Sequence
  source: /note="Description of Artificial Sequence: Synthetic polypeptide"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 307 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 308 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 309 - DNA, 738 bp, Artificial Sequence
  source: /note="Description of Artificial Sequence: Synthetic polynucleotide"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 310 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 311 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 312 - protein, 490 aa, Artificial Sequence
  source: /note="Description of Artificial Sequence: Synthetic polypeptide"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 313 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 314 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 315 - DNA, 723 bp, Artificial Sequence
  source: /note="Description of Artificial Sequence: Synthetic polynucleotide"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 316 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 317 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 318 - protein, 485 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 319 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 320 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 321 - DNA, 726 bp, Artificial Sequence
  source: /note="Description of Artificial Sequence: Synthetic polynucleotide"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 322 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 323 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 324 - protein, 486 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 326 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 327 - DNA, 744 bp, Artificial Sequence
  source: /note="Description of Artificial Sequence: Synthetic polynucleotide"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 328 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 329 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 330 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 332 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 333 - DNA, 732 bp, Artificial Sequence
  source: /note="Description of Artificial Sequence: Synthetic polynucleotide"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 334 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 335 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 336 - protein, 488 aa, Artificial Sequence
  source: /note="Description of Artificial Sequence: Synthetic polypeptide"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 337 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 338 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 339 - DNA, 733 bp, Artificial Sequence
  source: /note="Description of Artificial Sequence: Synthetic polynucleotide"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 340 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 341 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 342 - protein, 488 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 343 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 344 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 345 - DNA, 753 bp, Artificial Sequence
  source: /note="Description of Artificial Sequence: Synthetic polynucleotide"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 346 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 347 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 348 - protein, 495 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 349 - DNA, 1485 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 350 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 351 - DNA, 739 bp, Artificial Sequence
  source: /note="Description of Artificial Sequence: Synthetic polynucleotide"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 352 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 353 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 354 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 355 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 356 - protein, 4 aa, Artificial Sequence
  source: /note="Description of Artificial Sequence: Synthetic peptide"
RGDS

SEQ ID NO: 357 - DNA, 521 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 358 - DNA, 118 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtg

SEQ ID NO: 359 - DNA, 221 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 360 - DNA, 324 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 361 - DNA, 422 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 362 - DNA, 813 bp, Artificial Sequence
  source: /note="Description of Artificial Sequence: Synthetic polynucleotide"
atggccctgcccgtcaccgctctgctgctgccccttgctctgcttcttcatgcagcaaggccggacatccagatgacccaaaccacctcatccctctctgcctctcttggagacagggtgaccatttcttgtcgcgccagccaggacatcagcaagtatctgaactggtatcagcagaagccggacggaaccgtgaagctcctgatctaccatacctctcgcctgcatagcggcgtgccctcacgcttctctggaagcggatcaggaaccgattattctctcactatttcaaatcttgagcaggaagatattgccacctatttctgccagcagggtaataccctgccctacaccttcggaggagggaccaagctcgaaatcaccggtggaggaggcagcggcggtggagggtctggtggaggtggttctgaggtgaagctgcaagaatcaggccctggacttgtggccccttcacagtccctgagcgtgacttgcaccgtgtccggagtctccctgcccgactacggagtgtcatggatcagacaacctccacggaaaggactggaatggctcggtgtcatctggggtagcgaaactacttactacaattcagccctcaaaagcaggctgactattatcaaggacaacagcaagtcccaagtctttcttaagatgaactcactccagactgacgacaccgcaatctactattgtgctaagcactactactacggaggatcctacgctatggattactggggacaaggtacttccgtcactgtctcttcacaccatcatcaccatcaccatcac

SEQ ID NO: 363 - protein, 30 aa, Artificial Sequence
  source: /note="Description of Artificial Sequence: Synthetic polypeptide"
  MISC_FEATURE (1)..(30): /note="This sequence may encompass 1-6 'Gly Gly Gly Gly Ser' repeating units, wherein some positions may be absent"
  source: /note="See specification as filed for detailed description of substitutions and preferred embodiments"
GGGGSGGGGSGGGGSGGGGSGGGGSGGGGS

SEQ ID NO: 364 - protein, 35 aa, Artificial Sequence
  Description of Artificial Sequence: Synthetic polypeptide
TKKKYSSSVHDPNGEYMFMRAVNTAKKSRLTDVTL

SEQ ID NO: 365 - DNA, 105 bp, Artificial Sequence
  Description of Artificial Sequence: Synthetic polynucleotide
acaaaaaagaagtattcatccagtgtgcacgaccctaacggtgaatacatgttcatgagagcagtgaacacagccaaaaaatccagactcacagatgtgacccta

What is claimed is:

1. A method of making an immune effector cell population comprising an immune effector cell comprising a chimeric antigen receptor ("CAR"), comprising acquiring a human immune effector cell population from a pediatric subject having a leukemia, wherein the subject has not been treated with cyclophosphamide or cytarabine,
   thereby making an immune effector cell population suitable for use in a CAR therapy, wherein the acquired immune effector cell population includes:
   (a) one or more of at least 20% naïve T cells, at least 2% stem central memory T cells, and at least 4% central memory T cells;
   (b) at least 50% central memory T cells;
   (c) less than 55% effector memory and terminal effector T cells combined; or
   (d) two or more of (a), (b) and (c), wherein the combined percentages of the two or more of (a), (b), and (c) do not yield a percentage that exceeds 100%; and
   wherein the method further comprises introducing into the immune effector cell population a nucleic acid encoding a CAR; and
   wherein the immune effector cell population shows an increase in one or more of: (i) ex-vivo expansion of the immune effector cell population, (ii) the efficacy of the immune effector cell population for therapy, or (iii) the yield of the immune effector cell population, relative to a population of immune effector cells acquired from a pediatric subject having a leukemia who has been treated with cyclophosphamide or cytarabine.

2. The method of claim 1, wherein the CAR therapy comprises a CD19 CAR molecule comprising a sequence set forth in any one of SEQ ID NOs: 39-102, 107-121, and 362.

3. The method of claim 1, wherein the subject is 18 years of age of younger or is 10 years of age or younger.

4. The method of claim 1, wherein the leukemia is chosen from one or more of: a B-cell acute lymphoblastic leukemia (B-ALL), T-cell acute lymphoblastic leukemia (T-ALL), acute lymphoblastic leukemia (ALL), chronic myelogenous leukemia (CML), chronic lymphocytic leukemia (CLL), B cell promyelocytic leukemia, and hairy cell leukemia.

5. The method of claim 4, wherein:
   (i) the leukemia is a CLL or an ALL;
   (ii) the subject is classified as having standard-risk, high-risk, or very high-risk ALL;
   (iii) the subject does not have a lymphoma; or
   (iv) the subject does not have a relapsed leukemia.

6. The method of claim 1, further comprising acquiring the immune effector cell population from the pediatric subject according to the timing of administration of chemotherapy to the subject in relation to the timing of the immune effector cell acquisition, wherein the chemotherapy or cycle of chemotherapy comprises one or more of an induction, a consolidation, an interim maintenance, a delayed intensification, or a maintenance therapy cycle, and wherein:
   (i) the immune effector cell population is acquired from the subject before the subject has undergone a consolidation cycle of chemotherapy or an induction cycle of chemotherapy;
   (ii) wherein the immune effector cell population is acquired from the subject before the subject has undergone a consolidation cycle of chemotherapy;
   (iii) the subject is classified as having a high-risk or very high-risk cancer and the cells are harvested before the subject has undergone a consolidation cycle;
   (iv) the immune effector cell population is acquired from the subject before the subject has undergone a delayed intensification cycle; or
   (v) the subject is classified as having a high-risk or very high-risk cancer and the cells are harvested before the subject has undergone a delayed intensification cycle.

7. The method of claim 6, wherein:
   (a) one or more chemotherapy cycles or drugs are chosen from the group consisting of:
      (i) vincristine, dexamethasone, PEG-L-asparaginase, daunorubicin;
      (ii) vincristine, 6-mercaptopurine, cyclophosphamide, cytarabine, PEG-L-asparaginase;
      (iii) vincristine, methotrexate, 6-mercaptopurine;
      (iv) vincristine, dexamethasone, doxorubicin, PEG-L-asparaginase, cyclophosphamide, cytarabine, 6-thioguanine;
      (v) vincristine, methotrexate, and
      (vi) vincristine, dexamethasone, prednisone 6-mercaptopurine, methotrexate;
   (b) the chemotherapy comprises a drug and dosing regimen for the treatment of subject classified as having standard-risk cancer is chosen from the group consisting of:
      (i) vincristine 6 mg/m$^2$, dexamethasone 6 mg/m$^2$, PEG-L-asparaginase 2500 U/m$^2$;
      (ii) vincristine 1.5 mg/m$^2$, 6-mercaptopurine 75 mg/m$^2$;

(iii) vincristine 7.5 mg/m², methotrexate 500 mg/m²;
(iv) vincristine 4.5 mg/m², dexamethasone 10 mg/m², doxorubicin 75 mg/m², PEG-L-asparaginase 2500 U/m², cyclophosphamide 1 g/m², cytarabine 60 mg/m², 6-thioguanine 60 mg/m²;
(v) vincristine 7.5 mg/m², methotrexate 500 mg/m²; and
(vi) vincristine 1.5 mg/m², dexamethasone 6 mg/m², 6-mercaptopurine 75 mg/m², methotrexate 20 mg/m²;

(c) the chemotherapy comprises a drug and dosing regimen for the treatment of subject classified as having high-risk cancer is chosen from the group consisting of:
(i) vincristine 6 mg/m², dexamethasone 6 mg/m², PEG-L-asparaginase 2500 U/m², daunorubicin 100 mg/m²;
(ii) vincristine 1.5 mg/m², 6-mercaptopurine 60 mg/m², cyclophosphamide 1 g/m², cytarabine 75 mg/m², PEG-L-asparaginase 2500 mg/m²;
(iii) vincristine 7.5 mg/m², methotrexate 20 mg/m², 6-mercaptopurine 25 mg/m²;
(iv) vincristine 7.5 mg/m², dexamethasone 10 mg/m², doxorubicin 75 mg/m², PEG-L-asparaginase 5000 U/m², cyclophosphamide 1 g/m², cytarabine 60 mg/m², 6-thioguanine 60 mg/m²; and
(v) vincristine 1.5 mg/m², prednisone 40 mg/m², 6-mercaptopurine 75 mg/m², methotrexate 20 mg/m²; or (d) the chemotherapy comprises one or more of vincristine, dexamethasone, PEG-L-asparaginase, daunorubicin, 6-mercaptopurine, cyclophosphamide, cytarabine, methotrexate, doxorubicin, 6-thioguanine, and prednisone.

8. The method of claim 1, wherein the immune effector cell population suitable for use in a CAR therapy comprises a higher number of less differentiated T cells.

9. The method of claim 1, wherein:
(i) the immune effector cell population suitable for use in a CAR therapy shows an increased absolute T cell count (ATC), compared to a reference value; or
(ii) the immune effector cell population suitable for use in a CAR therapy comprises one or more of an absolute T cell count of at least 400 cells/microliter, an absolute naïve T cell count of at least 200 cells/microliter, an absolute stem central memory T cell count of at least 20 cells/microliter, or an absolute central memory T cell count of at least 40 cells/microliter.

10. The method of claim 1, wherein the immune effector cell population suitable for use in a CAR therapy is selected based upon the expression of one or more markers chosen from CCR7, CD62L, CD45RO, and CD95.

11. The method of claim 1, wherein the naïve T cells are identified based upon an expression pattern of CCR7+, CD62L+, CD45RO−, CD95−, wherein the stem central memory T cells are identified based upon an expression pattern of CCR7+, CD62L+, CD45RO−, CD95+, and wherein the central memory T cells are identified based upon an expression pattern of CCR7+, CD62L+, CD45RO+, CD95+.

12. The method of claim 1, wherein the immune effector cell population has been selected based upon the expression of one or more markers chosen from CD3, CD28, CD4, CD8, CD45RA, and CD45RO.

13. The method of claim 1, further comprising: activating the immune effector cell population, or transducing the immune effector cell population with a viral vector comprising a nucleic acid encoding a CAR.

14. The method of claim 1, wherein the immune effector cells are acquired from the subject prior to introduction of a CAR molecule into the immune effector cell.

15. The method of claim 1, wherein the CAR is a CD19 CAR.

* * * * *

UNITED STATES PATENT AND TRADEMARK OFFICE
CERTIFICATE OF CORRECTION

| | | |
|---|---|---|
| PATENT NO. | : 11,896,614 B2 | Page 1 of 1 |
| APPLICATION NO. | : 15/567156 | |
| DATED | : February 13, 2024 | |
| INVENTOR(S) | : Barrett et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 589 days.

Signed and Sealed this
Eighth Day of October, 2024

Katherine Kelly Vidal
*Director of the United States Patent and Trademark Office*